United States Patent 11,098,302 (IDENTIFICATION OF POLYNUCLEOTIDES ASSOCIATED WITH A SAMPLE) - sequence listing, part 179

SEQ ID NO: 781385 - DNA, 498 bp, Homo sapiens
  misc_feature: HIJSMM301AEQR8.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaagctgaagatgctgcaacttattactgtcatcagagtactactttacctcaagtgatcaccttcggaccaagggacacgactggagaattaaacgaactagtggctgcaccatctgtctt

SEQ ID NO: 781386 - DNA, 506 bp, Homo sapiens
  misc_feature: HIJSMM301AOZU4.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtaggaaatcatggggtattcgggcggagggaccaagctgaccgtccgtaggtcacgcccaaggctcgccccctcgtctacc

SEQ ID NO: 781387 - DNA, 528 bp, Homo sapiens
  misc_feature: HIJSMM301ECEMJ.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgagggctgattattactgccactcatatagaagtagtactactcctgtggttttcggcggagggaccaagctcgaccggttcctaggtcacggacccaaggctcggccccctcggtcctactctcgttccccccg

SEQ ID NO: 781388 - DNA, 510 bp, Homo sapiens
  misc_feature: HIJSMM301EPMRK.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccgggggtccctgaccgattcagtggcagcgggtctgggacagatttcactctcaccatcagcagcctgcaggctgaagatgtggcagtttattattgtcagcaattattatattccctccttcagacgttcggcccaagggacccaaggtaggaaatcaaaacgaactggtcggcttgcacctaa

SEQ ID NO: 781389 - DNA, 502 bp, Homo sapiens; identical to SEQ ID NO: 649724
  misc_feature: HIJSMM301B7C1C.13.11.A11.1.454.light.4.raw

SEQ ID NO: 781390 - DNA, 495 bp, Homo sapiens
  misc_feature: HIJSMM301BO7I3.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggcctaggggacctaagcgtggagatcaaacgaactgtgctgctaccatcttcg

SEQ ID NO: 781391 - DNA, 499 bp, Homo sapiens
  misc_feature: HIJSMM301EJKEA.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcaggtttccagccaccctgtctgtgtctccaggggagagagccacccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgctagttttattactgtcagcattacaataactggcctcggctcactttcggcggagggaccgaagggtaggaggatacaaacgaaacctggtggctgacaccat

SEQ ID NO: 781392 - DNA, 505 bp, Homo sapiens
  misc_feature: HIJSMM301BBQIZ.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctggaggacgaggctgattactactgctgctcatatgcaggtcgtatctcttatgtcttcggaactgggaccaaggtcaccgtctaggtcacgcccaaggcccaacccactgtcta

SEQ ID NO: 781393 - DNA, 478 bp, Homo sapiens
  misc_feature: HIJSMM301ERX1L.51.67.G01.1.454.light.4.raw
  modified_base (413)..(413): a, c, t, g, unknown or other
cgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccatttggaaacaggggtcccatcaaggttcagtggaagtggctctgggacagtattttactttcaccatcagcaggctgcagcctgaagacattgcaactatattactgtcaacagtanggatagtctcccgctcactttcggcgggggaccaaggtggagatcaagcgaactgtggctgcacc

SEQ ID NO: 781394 - DNA, 490 bp, Homo sapiens
  misc_feature: HIJSMM301EBLGN.5.57.F02.1.454.light.4.raw
  modified_base (483)..(483): a, c, t, g, unknown or other
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggccaggaccacatggatatcagcgaactgtggctgtcaccanctgtctt

SEQ ID NO: 781395 - DNA, 447 bp, Homo sapiens; identical to SEQ ID NO: 535020
  misc_feature: HIJSMM301BJ1GY.18.9.A09.1.454.light.4.raw

SEQ ID NO: 781396 - DNA, 503 bp, Homo sapiens
  misc_feature: HIJSMM301D5XJS.18.59.F04.1.454.light.4.raw
  modified_base (451)..(451): a, c, t, g, unknown or other
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgatttattactgcagctcatatacaagcaccagcactctctatntcttcggaactgggaccaaggtcaccgtctaggtcagcccaaggcccaaccc

SEQ ID NO: 781397 - DNA, 484 bp, Homo sapiens; identical to SEQ ID NO: 558109
  misc_feature: HIJSMM301BAREY.3.10.A10.1.454.light.4.raw

SEQ ID NO: 781398 - DNA, 515 bp, Homo sapiens
  misc_feature: HIJSMM301A2ZI9.8.42.D09.1.454.light.4.raw
ctcgcgtgtccacgaccggtgctcgatttagacacatacgcaggggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatggaggctgattattactgcagctacatattcaggcagcaacagggtatcggcggagggaccaagttgaccgtcctaggtacagccaaggctcgccccctcggtcactctcgttcccaccctcc

SEQ ID NO: 781399 - DNA, 535 bp, Homo sapiens
  misc_feature: HIJSMM301AFJIY.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccgaggggtttctgatcgcttctatggctccaagtctgcctacaccggcctccctgaccatctccgggctccagcctgaggacgaggctgattattattgtagttcatatacaaccagtgacacttgggtggttcgggcgggagggaccgaggactcgacccgtcccaggtcacgcccaaggcctcgccccctccggtcctactctcgttccccg

SEQ ID NO: 781400 - DNA, 518 bp, Homo sapiens
  misc_feature: HIJSMM301AY0U9.17.33.C11.1.454.light.4.raw
  modified_base (465)..(465): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacggaggctgactattactgcctactctactttggtggtgctgtgctattcgggcggagggacaagctgaccgtnttaagtcagcccaaggctcgccccctcggtcactctcgttcccgccctcctcc

SEQ ID NO: 781401 - DNA, 384 bp, Homo sapiens
  misc_feature: HIJSMM301D1DKE.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcactcttcccgccatctgaatagtataga

SEQ ID NO: 781402 - DNA, 510 bp, Homo sapiens
  misc_feature: HIJSMM301A1SVQ.13.38.D05.1.454.light.4.raw
tcacgtactacacgaccggtgctcgatttagtatctgatagttgggtttggggtgggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggccacccggctcgaccgtccgtcggtcacgcccaaggctgccccc

SEQ ID NO: 781403 - DNA, 503 bp, Homo sapiens
  misc_feature: HIJSMM301DF427.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctagaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgacaggctcgccccctcggt

SEQ ID NO: 781404 - DNA, 494 bp, Homo sapiens
  misc_feature: HIJSMM301AEJQA.48.10.A10.1.454.light.4.raw
agtatacatacacgaccggtgctcgatttagcgtcgatctcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagttgggggtcccatcaagattcagcggcagtggatctggaacagaattcactctcaccatcagcggcctgcagtctgatgattttgactaacttatttctgccaacagtatcatacttattctcggtacctcggccgacggaccgagggtaggaagtacaacgtaacgtagtggtcgtgcgaccatcttcgtcttc

SEQ ID NO: 781405 - DNA, 491 bp, Homo sapiens
  misc_feature: HIJSMM301AVZGC.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagtatttttctctcgtcatcactggtctacagtctgacgacggcgcaatgtacttctgtcaacactatgcctcctccccctacaatttcggtcagggaccaagttgaacatcaatcgaactgtggctgcaccta

SEQ ID NO: 781406 - DNA, 421 bp, Homo sapiens; identical to SEQ ID NO: 718022
  misc_feature: HIJSMM301D17L3.18.78.H01.1.454.light.4.raw

SEQ ID NO: 781407 - DNA, 505 bp, Homo sapiens
  misc_feature: HIJSMM301B3E1T.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcactactgtcgtttggtgttcggcggaggaccaagttgaccgtcctagtcagcccaaggctcgccccctcggtcacttc

SEQ ID NO: 781408 - DNA, 516 bp, Homo sapiens
  misc_feature: HIJSMM301AOQYK.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggcccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggcgactattattgtcaggtgtgggatagtagtagtgatcatgtggtattcggcggagggaccaagctgaccgtccttggtcagcccaaggctcgccccctcggtcactctcgttcccaccct

SEQ ID NO: 781409 - DNA, 485 bp, Homo sapiens
  misc_feature: HIJSMM301EYGFN.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtgatctgggacaaatttcactctcaccatcaatagcctgcaggctgaagatgtggcagcttattattgtcagcaataattatacttctcttccgatcacttttggccaggggaccaggctggagatcagacgaactgtggtc

SEQ ID NO: 781410 - DNA, 504 bp, Homo sapiens
  misc_feature: HIJSMM301BFSZ7.13.67.G01.1.454.light.4.raw
tcacgtactacacgaccggtgctcgatttagagtatacatattggggtttggggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggcctctactttcggcggagggaccaagggtaggagagtacaaaacggaact

SEQ ID NO: 781411 - DNA, 507 bp, Homo sapiens; identical to SEQ ID NO: 626454
  misc_feature: HIJSMM301CDSQI.8.28.C06.1.454.light.4.raw

SEQ ID NO: 781412 - DNA, 505 bp, Homo sapiens
  misc_feature: HIJSMM301AXC8U.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagtattttactctcggcatccgcagcctgcagcctgaagattttgcgacatattactgtcaacagtatgaaaatgtcccgctcacgttcggcgggggaccgaaggtggtagttacaaacgaactagtggcgtgcaccatctcgtcttcattccc

SEQ ID NO: 781413 - DNA, 490 bp, Homo sapiens; identical to SEQ ID NO: 639556
  misc_feature: HIJSMM301BBQ2W.26.23.C01.1.454.light.4.raw

SEQ ID NO: 781414 - DNA, 498 bp, Homo sapiens
  misc_feature: HIJSMM301AZUJL.41.35.D02.1.454.light.4.raw
tctatactatcacgaccggtgctcgatttagcacacgatagttgggtttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaacgccccccaaactccctgactttatgagggcgatcagcggccctcaggggtttctgatcgcttctctggctccaagtctggcaatacggcctccctgacagtctctcggctccaggcggaggacgaggctgattattactgcagctcatatacaagcagcagcactctggtggtagttcgggcggagggaccaagctgaccgtcctaggtcacgccc

SEQ ID NO: 781415 - DNA, 520 bp, Homo sapiens
  misc_feature: HIJSMM301AE6CW.13.36.D03.1.454.light.4.raw
  modified_base (456)..(456): a, c, t, g, unknown or other
tcacgtactacacgaccggtgctcgatttagctgcgtcacgatctctcgttgggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaacgcccccaaactcattatttacggggtcaataagccggccctcagggctttctgatcgcttctctggctccaagtctggcaacacggcctcctgacaatctctggactccaggccgaggacgaggctgtatttttactgttgttcatatgcgaggaaggagtgatttatgttntttaggaagtgggaccaaggtccaccgtccttggtcacgcccaaggcccaaccccactgtctac

SEQ ID NO: 781416 - DNA, 488 bp, Homo sapiens
  misc_feature: HIJSMM301AI89X.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcaccgtcccaagaacttttggccaggggaccaagctcggagatcaaacgaactgtggctgcaccat

SEQ ID NO: 781417 - DNA, 505 bp, Homo sapiens; identical to SEQ ID NO: 637304
  misc_feature: HIJSMM301DWDVM.18.59.F04.1.454.light.4.raw

SEQ ID NO: 781418 - DNA, 509 bp, Homo sapiens
  misc_feature: HIJSMM301BPILD.9.55.E11.1.454.light.4.raw
  modified_base (464)..(464): a, c, t, g, unknown or other
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctagggaaaacggccaccctgaccatcagcagggtcgaagccggggatgaggcgactattactgtcaggtgtgggctggtgataatgatcatgcgggggtgttcggcggagggaccaagcngaccgtctaagtcagcccaaggctcgccccctcggtcactctccg

SEQ ID NO: 781419 - DNA, 495 bp, Homo sapiens
  misc_feature: HIJSMM301DCJ36.18.11.A11.1.454.light.4.raw
  modified_base (474)..(474): a, c, t, g, unknown or other
  modified_base (483)..(483): a, c, t, g, unknown or other
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaactgcaggctgaagatgtggctagtttattactgtcagcaatactatacgtcctcctctcacggttcggcggagggaccaaggtggagatacaaacgaactgtggctgccaacntctgtcttnatcttcccgcat

SEQ ID NO: 781420 - DNA, 509 bp, Homo sapiens
  misc_feature: HIJSMM301C36TP.10.88.H11.1.454.light.4.raw
catagtagtgcacgaccggtgctcgatttagcgacagcgagaacacacaaaggggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtaggaaatcaaacgaactgtggctgcaccatctgtcttcatcttcccgcc

SEQ ID NO: 781421 - DNA, 500 bp, Homo sapiens
  misc_feature: HIJSMM301AYUXL.48.57.F02.1.454.light.4.raw
  modified_base (487)..(487): a, c, t, g, unknown or other
agtatacatacacgaccggtgctcgatttagctcgatatagttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagaggtctgggacggaattcactctcaccatcagcagtctgcagtctgaagattttgcagttttattattgtcagcagtataataattggcctccggggtcacttcggccctgggaccgaaaataaagtatcaatcgaactgtggctgnaccatctgtcttc

SEQ ID NO: 781422 - DNA, 514 bp, Homo sapiens
  misc_feature: HIJSMM301DJYZ1.16.46.E02.1.454.light.4.raw
tgtactactccacgaccggtgctcgatttagactcatctacagggaaaggggggggatctcaggaggcagctctctcggaatatctccaccatggcctgggctctgctcctccttaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagccccaggcacagcccccaaactcatgatttatgaagtcagtaatcggcctcaggggtccctgatcgcttctctgggtccaagtctggcaacacggcctccctgaccatctctgggctccaggctgaggacgaggctgattattactgcagcttatatacaggcaacaattacttttgtcttcggaactgggaccaaggtcaccgttcctaggtcagcccaaggccaaccccactgtcactctcgtt

SEQ ID NO: 781423 - DNA, 522 bp, Homo sapiens
  misc_feature: HIJSMM301CYTLX.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggcgaggctgattacttcgtgttgctcttgggcaactactgttcggtttgggtggttcggcggagggaccgaagttgaccgttcctaggtcacgccaaggctcggccccctcggtcactctcgttcccccg

SEQ ID NO: 781424 - DNA, 498 bp, Homo sapiens
  misc_feature: HIJSMM301EV1Z3.51.12.B01.1.454.light.4.raw
cgatcgtatacacgaccggtgctcgatttagtagtgtagattcgttcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaacggccaaccccactgtcactctcg

SEQ ID NO: 781425 - DNA, 512 bp, Homo sapiens
  misc_feature: HIJSMM301D250O.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatccacccaaataaacgcccccaaactcatcatttatgatgccactaagcggccctcaggggtttctaatcgcttctctggctccaagtctggcaacacggcctccctgacaatctctgggctccaggctgaggacgaggctgatttactactgctgcctcaatatgcagggtcttatctcttatgtcttcggaactgggaccaaggtcaccgtcctaggtcagcccaaggcccaaccccatcgt

SEQ ID NO: 781426 - DNA, 448 bp, Homo sapiens
  misc_feature: HIJSMM301E3FT4.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacaggtttgggtgtttgggtgttcggcggagggaccaagctgaccgtcctaagtcagcccaaggctcgccccctcggtcactctcgttcccacccctcctccgtgtctgat

SEQ ID NO: 781427 - DNA, 448 bp, Homo sapiens
  misc_feature: HIJSMM301BDET5.18.9.A09.1.454.light.4.raw
tacgagtatgcacgaccggtgctcgatttagcgagacgcgcagggtcctgggcccagtctgtgctgacgcagccgccatcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggcccaacccctctgtcactctgttcccgccctcctccatactcgta

SEQ ID NO: 781428 - DNA, 491 bp, Homo sapiens
  misc_feature: HIJSMM301BY49P.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaacccccccaactcatcatttatggtgtcactcgtcggccctcaggagtctctcatcgcttctcaggctccaagtctggcaacacggcctccctgaccgtctctgggctccaggctgaggatgaggctgattattactgcagctcatatggagcagcgacagtttggtgttcggcggagggaccaagctgaccgtctaggtcagcctaac

SEQ ID NO: 781429 - DNA, 500 bp, Homo sapiens
  misc_feature: HIJSMM301CFSAT.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattaactgtaactcccgggccagcagtggtaacattgtgatattcggcgggagggaccaaggtcgaccgtcctacgtcagcccaaggctgccccctcggtcactctcg

SEQ ID NO: 781430 - DNA, 485 bp, Homo sapiens
  misc_feature: HIJSMM301AN9C7.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggcctcccaggctcctcatctatgttgcatccagcagggcccactggtaccccagccaggttcagtggcagtgggtctgggacagagttcactctcaccatcagcagcctgcagtctgaagtattttgctagtttattactgtcagcagtataattactggcctcggacgttcggccgaagggaccgaaggtggaagtcgaaacgaacgtagtggc

SEQ ID NO: 781431 - DNA, 490 bp, Homo sapiens
  misc_feature: HIJSMM301AKEO8.4.39.D06.1.454.light.4.raw
agcactgtagcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacaggagttcactctaaccatcagcagcctgcagcctgatgatcttggaactttatttctgccagcaatataatagttattggacgttcggccgaggggaccaaggtacgaaatggaagacgaactgtggcgtgcaccattctgtt

SEQ ID NO: 781432 - DNA, 507 bp, Homo sapiens
  misc_feature: HIJSMM301A4N2D.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccgacgggaccgaaccggtcgggagtggtctaacgcgaaccgtagtcggcgttgcgtaccaatcttcg

SEQ ID NO: 781433 - DNA, 487 bp, Homo sapiens
  misc_feature: HIJSMM301DTUZA.51.30.C08.1.454.light.4.raw
cgatcgtatacacgaccggtgctcgatttagtctgacgtcaaagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtccgtcggtcacgcccaaggcctccgg

SEQ ID NO: 781434 - DNA, 491 bp, Homo sapiens
  misc_feature: HIJSMM301DH5IC.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcaggacaacactcaccttgaccatcagtgcagtccaggcagaagacgaggctgactattattgtcaatcagcagtcagcactaattcttatcgggtgttcgggcggagggaccaaatctcgaccgtcctaggtcagcccaaggcctcgccccctcggtctacc

SEQ ID NO: 781435 - DNA, 494 bp, Homo sapiens
  misc_feature: HIJSMM301AW339.26.12.B01.1.454.light.4.raw
  modified_base (467)..(467): a, c, t, g, unknown or other
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagtatttgcagtctattactgtcagcaatataattactggctctctttccggcgggggaccgaagctgganatcaaccgaactggtggctgcaccatc

SEQ ID NO: 781436 - DNA, 470 bp, Homo sapiens
  misc_feature: HIJSMM301ETR4N.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggcaagggacacgactgagattaacgaa

SEQ ID NO: 781437 - DNA, 508 bp, Homo sapiens
  misc_feature: HIJSMM301EXQPF.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctggaggacggaggctgattattactgcagctcatatacaagcaccagcactctctatgtcttcggaactgggaccaaggtcaccgtcctaggtcagcccaaggcccaaccccac

SEQ ID NO: 781438 - DNA, 493 bp, Homo sapiens
  misc_feature: HIJSMM301EPRR1.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcaggcgggtctgggacagatttcactctcaccatcagcagccctgcaggctgaagatgtggctagttttattattgtcaacaatattattatacttcgtggacgttcggccgaagggaccgaaggtggatagtcagacgaa

SEQ ID NO: 781439 - DNA, 477 bp, Homo sapiens
  misc_feature: HIJSMM301DY9ZV.40.59.F04.1.454.light.4.raw
  modified_base (445)..(445): a, c, t, g, unknown or other
tctagcgactcacgaccggtgctcgatttagtacacacacttagggattgggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagagtagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggcatcagcagtgaggtggtttggcggnggaccaagctgaccgtcctaagtcagcccaac

SEQ ID NO: 781440 - DNA, 514 bp, Homo sapiens
  misc_feature: HIJSMM301CCP03.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcgaggggtttctgatcgcttctctggctccaagtctggcaacacggcctccctgacaatctctgggctccaggctgaggacgaggctgattattattgctgctcatatgcaggttagttacactttatgtcttacgggaattggggacgtacggtcaccgtcctaggtcacgccccaaaggcccaaaccccgta

SEQ ID NO: 781441 - DNA, 495 bp, Homo sapiens
  misc_feature: HIJSMM301B3EGE.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcgggtcagagttcactctcaccatcagcagcctgcagtctgaagtattttgtctagtttattacttgtcagcagtatgatacctggcctccgtactacttttggccggggaccagctaggaatcaagcgaactgtggctgcaccatctgtcttcatt

SEQ ID NO: 781442 - DNA, 502 bp, Homo sapiens
  misc_feature: HIJSMM301CIJKB.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctcctgaccgtctctgggctccaagctgaggatgaggctggattattactgcagctcatatgcaggcagcagcaatgtacttttcggcggagggacaagctgaccgtctggtcagccaaggctgccccctcggtctacg

SEQ ID NO: 781443 - DNA, 513 bp, Homo sapiens
  misc_feature: HIJSMM301CT4FS.19.67.G01.1.454.light.4.raw
tactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaatttttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagacgtgagggacgaggctgactactactgtcagtcttatgatagccgcggtcatgtggtcttcggtcggagggaccgaaggctgaccgtcctacggtcagcccaaggccgtgcccccctcc

SEQ ID NO: 781444 - DNA, 494 bp, Homo sapiens
  misc_feature: HIJSMM301A6B76.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtggggtctgggacagacttcactctcaccatcagcagcctagagcctgaagattttgcagtttattactgtcagcagcgtagcaactggcctctcaccgttcggcggaggggaccaaggtggagatcaaacgaactgtggctgcaccatctgtt

SEQ ID NO: 781445 - DNA, 521 bp, Homo sapiens
  misc_feature: HIJSMM301DG9WW.41.45.E01.1.454.light.4.raw
tctatactatcacgaccggtgctcgatttagtgagtcagtaagggaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagcacgttgaccatcagtggagtccaggcagaagacgaggctgactattattgtcaagcagtagacagcagtggtccttagtcgggttgttcgggcggggggaccaaggcgtcgaccggttccgtaggtctacggcccaaggctcgcccccgtcgggtcaccgttccg

SEQ ID NO: 781446 - DNA, 477 bp, Homo sapiens
  misc_feature: HIJSMM301A8498.49.27.C05.1.454.light.4.raw
agtcgagagacacgaccggtgctcgatttagacgcgatcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagtattttactttcaccatcagcaggctgcagcctgaagatattgacaacatattactgtcaacagtatgatacgtctcccgtctctacgtttcgggcggggggtaccgaaggtggagatcaagcgaa

SEQ ID NO: 781447 - DNA, 504 bp, Homo sapiens
  misc_feature: HIJSMM301CAKVT.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagcccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggcctaggggaccaagctggagatcaaacgaactgtggctgcaccatctgtcttcacttcc

SEQ ID NO: 781448 - DNA, 507 bp, Homo sapiens
  misc_feature: HIJSMM301DV7AN.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaagtcccggggtccctgaccgattcagtggcaggcgggtctgggacagatttcactctcaccatcagcagcctgcaggctgaagatgtggctagtttattattgtacaacaattattaattacttacttcgtgggtaccgttcggaccgtaacgggaaccgaagggtaggatatcagaacgaa

SEQ ID NO: 781449 - DNA, 515 bp, Homo sapiens
  misc_feature: HIJSMM301BIWOJ.7.34.D01.1.454.light.4.raw
cgtgtctctacacgaccggtgctcgatttagatcgtctgtgttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattattgggtgttcgggcggagggaccaagctgaccgtcctgcgtcagcccaaggctcgccccctcggtcacgtt

SEQ ID NO: 781450 - DNA, 501 bp, Homo sapiens
  misc_feature: HIJSMM301EDQ6A.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagatttttgctagttttattattgtcagcagcgaaacaactcggcctccttggacgttcggccgaagggaccaaggtggaaatacaaacgaactgtaggctagcaccatctgtcttc

SEQ ID NO: 781451 - DNA, 499 bp, Homo sapiens
  misc_feature: HIJSMM301CLGJD.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactagaaaatcagcagagtggaggctgaggagtgttggggtttattactgcatgcaagctctacaaactccttactacttttggccgtacggggaccaagctggagatacaaacgaactagt

SEQ ID NO: 781452 - DNA, 514 bp, Homo sapiens
  misc_feature: HIJSMM301BRQCN.14.36.D03.1.454.light.4.raw
  modified_base (441)..(441): a, c, t, g, unknown or other
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgatttattattgcagctcatatgcacctggcagnaaatcattgtgggttttcgggtcggggggaccgaaggtggtacccgtcctaggtcctacgcccgaaggtcccg

SEQ ID NO: 781453 - DNA, 491 bp, Homo sapiens
  misc_feature: HIJSMM301A9SUT.9.1.A01.1.454.light.4.raw
  modified_base (466)..(466): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcaggtgggtctgggacagacttcactctcaccatcagcagactggagcctgaggtattttgcagtgtattactgtcagcagtatcataggtcaaacaccttcggccgaaggacacgactggagataaaggaactgngctgcacatctgtcttcatctcccg

SEQ ID NO: 781454 - DNA, 505 bp, Homo sapiens
  misc_feature: HIJSMM301BTN5P.4.37.D04.1.454.light.4.raw
agcactgtagcacgaccggtgctcgatttagtagcatactgttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcgaggggtttctaatcgcttctctggttacaagtctggcaacacggcctccctgaccatctctgggctccaggctgaggacgaggctgattattactgcagctcatatacaagcagcagcacgtggggtcttcggaactgggaaccaggtcaccgtcgtcccacgtcagcccaaggcccaa

SEQ ID NO: 781455 - DNA, 498 bp, Homo sapiens
  misc_feature: HIJSMM301CQN1A.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctcctgaccgtctctgggctccaagctgaggatgaggctgattattactgcagctcatatgcaggcagcagcaatgtacttttggcggagggacaagctgaccgtctggtcagccaaggctcgccccctcggtct

SEQ ID NO: 781456 - DNA, 505 bp, Homo sapiens; identical to SEQ ID NO: 535503
  misc_feature: HIJSMM301ADOT3.8.28.C06.1.454.light.4.raw

SEQ ID NO: 781457 - DNA, 510 bp, Homo sapiens
  misc_feature: HIJSMM301CRLUE.10.27.C05.1.454.light.4.raw
catagtagtgcacgaccggtgctcgatttagacgcgatcgaaggggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttctaaggttttcggcggagggaccaggctgaccgtcctaagtcagcccaaggctcgccccctcggt

SEQ ID NO: 781458 - DNA, 490 bp, Homo sapiens
  misc_feature: HIJSMM301EVWMN.17.39.D06.1.454.light.4.raw
cgtagactagcacgaccggtgctcgatttagtgacatctcgcagtttctttgggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctggggacagagttctctctcatcatcagcagcctgcagtcctgaagtatttttgcggttttattactgtcagcagtataatcagtggcctcgtggacgttcggccaagggaccaaggtaggaatcgaaacgaactagtgg

SEQ ID NO: 781459 - DNA, 525 bp, Homo sapiens
  misc_feature: HIJSMM301ELUIT.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcagtcagcatattaccagccggttagcctggtatcagcagaaaccagggagagcccctaaactcctgatctctgctgcatccagtttacaaagtggggtcccatcgtcggttcagcggcagtggatagtgggacatatttcactctcgccatcagcagcctgcagcctagaagtattttgcaacttactattgtctaacaggctaactacgtttcccgtcctccaccttaccggggtccgggggggaacccgaagggttacgggaggtaactacaaaaccgtaaactacggttagggtcctaggtccaacc

SEQ ID NO: 781460 - DNA, 498 bp, Homo sapiens
  misc_feature: HIJSMM301C0T1Y.43.23.C01.1.454.light.4.raw
  modified_base (340)..(340): a, c, t, g, unknown or other
tgtgagtagtcacgaccggtgctcgatttagtacacgtgattagggattgggggctggggtctcaggaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgnttctctggctccaagtctggcaacacggcctcctgacaatctctgggctccgaggctgaggacgaggctgattattattgctgctcatatgcaggtagttacacttatgtacttcggaattgggacgacggtctaccgtcctaggtcacgcccaagga

SEQ ID NO: 781461 - DNA, 489 bp, Homo sapiens
  misc_feature: HIJSMM301CPBTL.13.59.F04.1.454.light.4.raw
  modified_base (467)..(467): a, c, t, g, unknown or other
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcggggtcccatctcggttcagtggcggtggatctaggacagaattcactctcaccatccaccaacctgccaccctgaagatgttggaagttattactgtcagacctatagtggtggcccgctctattttcggcggagggaccgaaggtgcagntacaaacgaactgtggctgcca

SEQ ID NO: 781462 - DNA, 509 bp, Homo sapiens
  misc_feature: HIJSMM301AXYX4.18.78.H01.1.454.light.4.raw
  modified_base (438)..(438): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctaggcaacacggcctccctgaccatctctgggctccaggctgaggacgaggctgattattactgcagctcatatacaagcaccngcactctctatgtcttcggaactgggaccaaggtcaccgtcctaggtcagcccaaggcccaaccccactgt

SEQ ID NO: 781463 - DNA, 492 bp, Homo sapiens
  misc_feature: HIJSMM301DUUTH.11.28.C06.1.454.light.4.raw
  modified_base (431)..(431): a, c, t, g, unknown or other
cgagagataccacgaccggtgctcgatttagagctcacgtattggggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactcgtgggtcccagacagattcagtggcagtgggtcaggcgctgatttcacactgagaatcagcagggtggaggctgaagatggtcggggtttattacgtgcatgnagggtacagtgtggccttcgctcgcattcggcggagggaccaagggtggagatcaaacgaa

SEQ ID NO: 781464 - DNA, 490 bp, Homo sapiens
  misc_feature: HIJSMM301CMB2Z.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcaatgatttatgaggtcagtaatcggccctcaggggtttctaatcgcttctctggctccaagtctggcaacacggcctccctgaccatctctgggctccaggctgaggacgtagggtgatttactatgcagctcatatagaagtggcagcactctcgtattcggcggtggaccaagctgaccgtctaggtcacgcc

SEQ ID NO: 781465 - DNA, 503 bp, Homo sapiens
  misc_feature: HIJSMM301AGCGW.41.18.B07.1.454.light.4.raw
tctatactatcacgaccggtgctcgatttagtcgctgcgtaaggggggggagcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttagtcgggttggttcgggcggggggaccaaggctgaccgtctaggtcagcccaaggcctccg

SEQ ID NO: 781466 - DNA, 524 bp, Homo sapiens
  misc_feature: HIJSMM301BGWNG.5.59.F04.1.454.light.4.raw
atcagacacgcacgaccggtgctcgatttagtacacacacttagggattggggctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgttattactgtcagcagtatggtagctcacggacgttcggccgaacgggacgaacggtaggaaatacgtaaacgaactacgtggtcgtgcgaccactactgttcttctacttacttcccgtccctac

SEQ ID NO: 781467 - DNA, 570 bp, Homo sapiens
  misc_feature: HIJSMM301DGI94.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggttctgatcgcttctatggctccaagtctgcctacacggcctccctgaccatctccgggctccagcctgaggacgaggctgattattattgtagttcattatacaaccagtgactactttggggtgttcgggcggggtagggaccagggctcggacccgttaccgtaggttaccacggaccccgaagggtccgtccggccccccgttcggtcccgtacttccgttccggttcccccgtccccctt

SEQ ID NO: 781468 - DNA, 528 bp, Homo sapiens
  misc_feature: HIJSMM301BPT6V.27.23.C01.1.454.light.4.raw
  modified_base (226)..(226): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgctttataactttatctgttggtaccgacaggacccaggcactgtccccaaactcattctttatgatgtcagtaatcggccccaggggtttctgatcgcttctatggctccaagtctgcctacacggcctccctgacccatctccgggctccagcctgaggacgaggctgattattattgtagttcatatacaaccagtgacacttgggtgttcggcggagggaccagggctggaccgtcctaggtcagcccaaggctcgccccctcggcactctcgttcccgccctccg

SEQ ID NO: 781469 - DNA, 467 bp, Homo sapiens
  misc_feature: HIJSMM301EZWNE.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgccctcacactttcggcggagggaccaaggtggagatcaaacgaa

SEQ ID NO: 781470 - DNA, 536 bp, Homo sapiens
  misc_feature: HIJSMM301CBTWJ.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatcctccgggctccacgcctgaggaccgaggctgattattattgtagttcatatacaaccagtgacacttgggtgttcgggcggagggaccaggctcgaccgtcctaggtcacgcccaaggctcgccccctggtcctactctcgttccccgcccttccc

SEQ ID NO: 781471 - DNA, 479 bp, Homo sapiens
  misc_feature: HIJSMM301BNSM1.53.83.H06.1.454.light.4.raw
cgcgtatacacacgaccggtgctcgatttagatcacgtgcgtcgcggggctgggcctcaggaagcagcatcggaggtgccctcagccatggcatggatccctctcttcctcggcgtccttgcttactgcacaggatccgtggcctcctatgagctgactcagccaccctcagtgtccgtgtccccaggacagacagcgaccatcacctgttctggagacaaattgactgataaatatgctggctggtatcggcagaagccaggccagtcgcctgtgttggtcatctatcaggatagcaagcggccctcagggatccctgagcgattctctggctccaactctgggaacacagccactctgaccatcagcggactcaggctatcgatgaggctgactattactgtcaggcgtgggacagccgcacttgggggtattcgggcgggagggaccaaggctgaccgtcctgacgtcagaccccg

SEQ ID NO: 781472 - DNA, 521 bp, Homo sapiens
  misc_feature: HIJSMM301COHRK.43.81.H04.1.454.light.4.raw
tgtgagtagtcacgaccggtgctcgatttagtagtgtagattcgcgggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggcctccctccttgggggcaaagctgccctgacactgtcaggtgtgcaccctgaggacgaggctgagtattactgtctgctccactttcgtactgcctgggtcgttcgggcgggggactcagttgaccgtcctaggtcagccaaggctcgccccctcgtcactctcgttcccaccctcctcactactcac

SEQ ID NO: 781473 - DNA, 523 bp, Homo sapiens
  misc_feature: HIJSMM301B1PV7.12.53.E09.1.454.light.4.raw
atacgacgtacacgaccggtgctcgatttagagagagtgtgttgggtttgggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctcgaccgtccgttcggggtctacgcccgaacggctcgcccccttccc

SEQ ID NO: 781474 - DNA, 511 bp, Homo sapiens
  misc_feature: HIJSMM301E3H05.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccaggggccactggtatcccagccaggttcagtggcagtgggtctgggacagagttcactctcaccatcagcagcctgcagtctgaaagattttgcggtttattactgtcagtcagtataataactagctccacggtacactttagtccgaggacgaacgctggacgagtctaacgaaaactacggtaggtcgtcgcacactactctt

SEQ ID NO: 781475 - DNA, 498 bp, Homo sapiens
  misc_feature: HIJSMM301AK3CC.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcactt

SEQ ID NO: 781476 - DNA, 504 bp, Homo sapiens
  misc_feature: HIJSMM301C1NW9.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgatcgtcctgcgtcacgcccaaggcctgccccctcggtctacc

SEQ ID NO: 781477 - DNA, 514 bp, Homo sapiens
  misc_feature: HIJSMM301CD9VR.49.71.G05.1.454.light.4.raw
agtcgagagacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatggaggccgactattactgtcaggtctgggatactgaaattgaatatgtcttcggaactgggaccaaagtcaccgtcctaggtcagcccaaggccaaccccactgtcactctgttcccgcctcct

SEQ ID NO: 781478 - DNA, 482 bp, Homo sapiens
  misc_feature: HIJSMM301DM6PC.41.78.H01.1.454.light.4.raw
tctatactatcacgaccggtgctcgatttagtgtgagtagtttgggtttgggggatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcgggtccgggacagatttcacactgaggatcagtcgggtggaggctgacgacgttgggacttattactgcgcgcaaagtctacaccttcctctcactttgggccctgggaccaaagtggacatcaaacga

SEQ ID NO: 781479 - DNA, 502 bp, Homo sapiens
  misc_feature: HIJSMM301DJOLC.26.26.C04.1.454.light.4.raw
agactatactcacgaccggtgctcgatttagtctagcgactttgggtttgggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggagttccggggtcccagacagattcagcggcagtgggtcaggcactgatttcacgctgaacgatcagcagggtggaggctgaggatgttgtcggtttattactgccttgcagagtatcactggccgtggacgttcggcgacggaccaaggtaggaatcaaacgaactagtggctgcacc

SEQ ID NO: 781480 - DNA, 513 bp, Homo sapiens
  misc_feature: HIJSMM301A7T5W.16.1.A01.1.454.light.4.raw
  modified_base (415)..(415): a, c, t, g, unknown or other
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccacncatatagaagtagtactactcctgtcggttttcggcggtagggaccaagctgaccgtcctaggtcagcccaaggctcgccccctcggtcactctcgtt

SEQ ID NO: 781481 - DNA, 495 bp, Homo sapiens
  misc_feature: HIJSMM301B3WSB.13.10.A10.1.454.light.4.raw
tcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatggtagtgccatttctgctgtgttcggaggaggcaccggctgaccgtcctcggtcagcccaaggctgcccc

SEQ ID NO: 781482 - DNA, 486 bp, Homo sapiens
  misc_feature: HIJSMM301C7KHS.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggacacgactggagattaaacgaactgtggctgcaccact

SEQ ID NO: 781483 - DNA, 508 bp, Homo sapiens
  misc_feature: HIJSMM301AVR31.2.81.H04.1.454.light.4.raw
  modified_base (506)..(506): a, c, t, g, unknown or other
acgctcgacacacgaccggtgctcgatttagtagtgtagattcgcgggggggggtctcaggaggcagcgctctcaggacgtcaccaccatggcctgggctctgctcctcctcaccctcctcactcagggcacagggtcttgggcccagtctgccctgactcagcctccctccgcgtccgggtctcttggacagtcagtcaccatctcctgcactggaaccagcagtgacattggtgattatagacatgtctcctggtaccaacaggaaccaggcaaagccccccgactcataatttatgaggtcaataagcggccctcgaggggtccttgatcgcttctctggctccaagtctggcaacacggcctccctgaccgtctcgtgggctccaggctgacgatgaggctgattagttactgcagctcagaagcaggcaccaacaattgggtgttcggcggaggaccaagctgaccgtcttaggtcagcccaaggctcgccccctcggtcnct

SEQ ID NO: 781484 - DNA, 472 bp, Homo sapiens
  misc_feature: HIJSMM301CYI5Z.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcacacggctccctgaccatctctgggctccaggctgaggacaggctgattattattgcatctcatatacaaccaacagcactctcgactggtattcggcggagggaccaagctgaccgtcctaggtcagcccaaggcctgccccctcggtcactctgttcctaccctcctcgctacgtaga

SEQ ID NO: 781485 - DNA, 497 bp, Homo sapiens
  misc_feature: HIJSMM301CGHCJ.15.81.H04.1.454.light.4.raw
  modified_base (403)..(403): a, c, t, g, unknown or other
tctacgtagccacgaccggtgctcgatttagtagtgtagattcgcggggggggtctcaggaggcagtgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtnattattactgcagctcatatagaagtggcagcactctcgtattcggcggtgggaccaagctgaccgtcctaggtcagcccaaggctgccccctc

SEQ ID NO: 781486 - DNA, 497 bp, Homo sapiens
  misc_feature: HIJSMM301C23HX.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgacaggtcaccgtcctgggtcagcccaaggccaaccccactagtcactcc

SEQ ID NO: 781487 - DNA, 502 bp, Homo sapiens
  misc_feature: HIJSMM301DXVPI.19.85.H08.1.454.light.4.raw
tactctcgtgcacgaccggtgctcgattttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagatttttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccagctgccccctcggt

SEQ ID NO: 781488 - DNA, 507 bp, Homo sapiens
  misc_feature: HIJSMM301C3LQN.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggggactgggaccaagatcaccgtcctaggtcagacccaaggaccaacccactcgtcta

SEQ ID NO: 781489 - DNA, 512 bp, Homo sapiens
  misc_feature: HIJSMM301BYOKP.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcacggcccaaggcctcgccccctcggtcctaccg

SEQ ID NO: 781490 - DNA, 504 bp, Homo sapiens
  misc_feature: HIJSMM301AWCNN.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccgaggcagaggacgaggctgactattattgtcaatcaacagacaccattggtacttatgttcttcggaactgcgaccaaggtccaccgtccgtgggtcacgcccaacggcccaacccccactcgtcta

SEQ ID NO: 781491 - DNA, 501 bp, Homo sapiens
  misc_feature: HIJSMM301CJ8TN.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttgggtttattactgcatgcaagctctacaaactccttactacttttggccgtaggggacctaaaggctggagatcaaacgaactgtggtcc

SEQ ID NO: 781492 - DNA, 528 bp, Homo sapiens
  misc_feature: HIJSMM301BHPVW.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctcaagtctggcaacacggcctcctgaccgtctctgggctccaggctgaggatgaggctgattattactgcagctcatatgcaggcagcagcacggtccccaatgtgatcgttccgggccggggggaccaagccgtggacccgtcctacgggttcacgacccaacggacctcgtccccccccg

SEQ ID NO: 781493 - DNA, 491 bp, Homo sapiens
  misc_feature: HIJSMM301BSRKU.5.24.C02.1.454.light.4.raw
  modified_base (425)..(425): a, c, t, g, unknown or other
  modified_base (453)..(453): a, c, t, g, unknown or other
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagcncatatgcaggcagcagcagtccccatgngatcttcggcgggggacaagctgaccgtctagtcagcc

SEQ ID NO: 781494 - DNA, 501 bp, Homo sapiens
  misc_feature: HIJSMM301CN16X.48.10.A10.1.454.light.4.raw
  modified_base (381)..(381): a, c, t, g, unknown or other
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtcngtatgatttgctaacttatttctgccaacagtatctatacttattctcggacctcgcctaggaccgacgggtaggaaagtcgtaaaacgaactagtaggtctggtaccaccactacttcg

SEQ ID NO: 781495 - DNA, 493 bp, Homo sapiens
  misc_feature: HIJSMM301CXIPZ.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagtattttaggaacttattattgtcaaacagggtaacagtttccccgctccaccttcggcggagggaccaaggtggagatagaaaagactgtggctgcacat

SEQ ID NO: 781496 - DNA, 526 bp, Homo sapiens
  misc_feature: HIJSMM301D23OW.9.12.B01.1.454.light.4.raw
  modified_base (401)..(401): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgnggcagtttattactgtcaactagttttctcgggcgttcggtccgaacgggaccgaacgggtagggaaactacgaaaaccgtaactacggtaggccgtaggtccaacccgaattcctagttccttt

SEQ ID NO: 781497 - DNA, 518 bp, Homo sapiens
  misc_feature: HIJSMM301EFITI.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaaggccggggatgaggccgactattactgtcaggtgtgggatagtagtagtgatcattatgtcttcggatcgtgggaccagggtcaccgtctaggtcagcccaaggcccaacccactgtcactctgttccccgccctccg

SEQ ID NO: 781498 - DNA, 520 bp, Homo sapiens
  misc_feature: HIJSMM301C0PHK.10.38.D05.1.454.light.4.raw
catagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctcaagtctggcaacacggcctccctgaccgtctctgggctccaggctgaggatgaggctgattactactgcagcgcatattcaggccccaacagggtgtttgggcggcgggactaaggtgaccgtcctgggtcagcccaaggctcgccccctcggtcactctcgttcccaccct

SEQ ID NO: 781499 - DNA, 512 bp, Homo sapiens
  misc_feature: HIJSMM301BP3BH.12.55.E11.1.454.light.4.raw
  modified_base (357)..(357): a, c, t, g, unknown or other
  modified_base (500)..(500): a, c, t, g, unknown or other
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcaggccgcccggggcagtcgcccccaccactataatctatgaggatgaccgacgaccctctggggtccctgatcgtttctctggctccatcgacngctcctcaattctgcctccctcaccatctctggactcatgtctgaggacgaggctgactactactgtcagtcttatgtataatacgtctttgttttttcggcggtcgggaccgaagctgaccgtcctaggtcagcccaaggcncgcccctcggtc

SEQ ID NO: 781500 - DNA, 488 bp, Homo sapiens; identical to SEQ ID NO: 669330
  misc_feature: HIJSMM301ER6YW.14.55.E11.1.454.light.4.raw

SEQ ID NO: 781501 - DNA, 483 bp, Homo sapiens
  misc_feature: HIJSMM301CL71B.48.28.C06.1.454.light.4.raw
agtatacatacacgaccggtgctcgatttagagctcacgtattgggtttgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacacgccactctgaccatcagcgggacccaggctatggatgaggctgactattactgtcaggcgtgggacatcagcagtgaggtggttcggcgggtagggaccaagctgaccgtcctaagtcagcccaaggccg

SEQ ID NO: 781502 - DNA, 503 bp, Homo sapiens
  misc_feature: HIJSMM301AJO67.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtccctggtcagcccaaggctgccccctcggt

SEQ ID NO: 781503 - DNA, 513 bp, Homo sapiens
  misc_feature: HIJSMM301AUM6V.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgatggcgagagggaccagggcaccgtcctccagggagcccatgctgcaagtcgggccagaggtgcccctgaacctgaaggccaatgagacccaagacaggccaagtgggttgtgagacccctgaggagctgggccctgggtccccaggcagcgctggcccctgctgctgctgggtctggccatggtcgccatggcctgctgcgcccaatggttgcaccgcaaagcggggacccagacccctggagccctcacgttggaagcagccatccagcctgcggagcctgtggggcaggtcagcccaaggccaaccccgactgtcact

SEQ ID NO: 781504 - DNA, 505 bp, Homo sapiens
  misc_feature: HIJSMM301A80I7.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtccgtgggtcagcccaaggctgcccctcggtctac

SEQ ID NO: 781505 - DNA, 484 bp, Homo sapiens
  misc_feature: HIJSMM301AQFGV.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatcctttaaactggtatcatcagagaccagggaaggcccctaagttcctgatccatgatgcatccatctgcagagtggagtcccatccaggttcagtggcagtgggtctgggacagagttcactctcaccatcaacagtctgcagccagaggactttggaacctactattgaccaacagtacttacagtaccccccccacgttcggcggaggaccacagtcgagatcaaacgaactgtaggctgcaccat

SEQ ID NO: 781506 - DNA, 471 bp, Homo sapiens
  misc_feature: HIJSMM301B1ZDY.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcagggtcccatctcgattcagtggcagtggatctgggacaggatttcactctcaccatcagcagcctgcagccttgaagatgttgctaacttattactgtacaaaagaatagcgctcgcccgctcagtttcggcggagggaccaaggtggagataaccg

SEQ ID NO: 781507 - DNA, 527 bp, Homo sapiens
  misc_feature: HIJSMM301AKIZR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaacgggaaccgaaacgggtaggaaagtacgaaaacgaaacgtacgtggcgtggcaccaactctcgtcttctatcctttccccg

SEQ ID NO: 781508 - DNA, 518 bp, Homo sapiens; identical to SEQ ID NO: 755039
  misc_feature: HIJSMM301DYEKX.16.1.A01.1.454.light.4.raw

SEQ ID NO: 781509 - DNA, 504 bp, Homo sapiens
  misc_feature: HIJSMM301EX3NC.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcaggtgggtcggggtcagagttcactctcaccatcagcagcctgcagtctgaagtattttgctagtttattactgtcagcagtatgatacctggcctccgtacctacgttttgggccgggggaccaaggctaggaatcaagcgaactggtgctgcaccatctgtcttcattccc

SEQ ID NO: 781510 - DNA, 489 bp, Homo sapiens; identical to SEQ ID NO: 603863
  misc_feature: HIJSMM301DV90S.51.79.H02.1.454.light.4.raw

SEQ ID NO: 781511 - DNA, 504 bp, Homo sapiens
  misc_feature: HIJSMM301AF9Z8.19.10.A10.1.454.light.4.raw
tactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgagatttgcagtgtattactgtcaacgatatgatgagtcacctccgtggtggacatttggccaggggaccaaggttgaagtcaaaacgaactgtggctgcaccatctgtcttcactctttccccg

SEQ ID NO: 781512 - DNA, 497 bp, Homo sapiens
  misc_feature: HIJSMM301CZ3ZB.16.53.E09.1.454.light.4.raw
  modified_base (366)..(366): a, c, t, g, unknown or other
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcattgtaatggatacaactatttggattggtacctgcagaagccagggcagtctccacagctcctgatctatttgggttctaatcgggcctccggggtccctgacaggttcagtggcagtggatcaggnacagattttacactgaaaatcagcagagtggaggcttgaggatgttggggtttattactgcatgcaagctctacaaactccttacacttttggcctaggggaccaagactggagatcaaacgaactgtggt

SEQ ID NO: 781513 - DNA, 448 bp, Homo sapiens; identical to SEQ ID NO: 724723
  misc_feature: HIJSMM301B5YFO.18.9.A09.1.454.light.4.raw

SEQ ID NO: 781514 - DNA, 485 bp, Homo sapiens
  misc_feature: HIJSMM301B4ALT.40.8.A08.1.454.light.4.raw
tctagcgactcacgaccggtgctcgatttagcatactctacagggggagctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcaggcgggtctgggacagatttcactctcaccatcaacaacctgcaggctgaagatgtggctagtttattactgtacaacaatattatactactccgctacactttcggcggaggcaaccgaaggtggagatcagacgaa

SEQ ID NO: 781515 - DNA, 517 bp, Homo sapiens
  misc_feature: HIJSMM301BAKLA.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacagtggatagcagcctgagtactgtgataatcggcggagggaccaagctagaccgtctaggtcagcccaaggctcgcccccctcggtccactccttcgttcccgt

SEQ ID NO: 781516 - DNA, 506 bp, Homo sapiens
  misc_feature: HIJSMM301BDCAR.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcaagaaatctggccagcctcccaggctcctcatctatggtgaatccaacagggccactggcatcccagacaggttcagtggcagtgggtctgggacagacttcactctcaccatcagcagactggagccgtgaggtattttgcagtgtattactgtcagcagtatcataggtacaaacaccttcggccgaacgggacacgacgtggagaagttaaaggaactggtggctgcaccatctgtcttcactccttccccg

SEQ ID NO: 781517 - DNA, 486 bp, Homo sapiens; identical to SEQ ID NO: 543885
  misc_feature: HIJSMM301B8GWJ.17.25.C03.1.454.light.4.raw

SEQ ID NO: 781518 - DNA, 351 bp, Homo sapiens
  misc_feature: HIJSMM301DQQSC.19.22.B11.1.454.light.4.raw
tactctcgtgcacgaccggtgctcgatttagacgacagctcagggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactccaataataagaactacttagcttggttccagcagaaaccaggacagcctcctaagatgctctttattggcatctgcccgggaatccgggtcctgaccgattcagtggcagcgggtctgggacagatttcactctcacca

SEQ ID NO: 781519 - DNA, 501 bp, Homo sapiens; identical to SEQ ID NO: 674073
  misc_feature: HIJSMM301C1QGQ.47.66.F11.1.454.light.4.raw

SEQ ID NO: 781520 - DNA, 517 bp, Homo sapiens
  misc_feature: HIJSMM301D6Z2H.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtacaactagttttctcgggcgttcggtccgaagggaccgaaggtaggaaagtaccaaacgaactagtggctgccaaccgatctcgtcttcgtatcttccccg

SEQ ID NO: 781521 - DNA, 484 bp, Homo sapiens
  misc_feature: HIJSMM301DFX3N.19.25.C03.1.454.light.4.raw
  modified_base (199)..(199): a, c, t, g, unknown or other
  modified_base (433)..(433): a, c, t, g, unknown or other
tactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttattactgtcagcagtataataactggcctnagtactttcggcggagggaccgaaggtgggagagtacaaacgtaacgtagt

SEQ ID NO: 781522 - DNA, 510 bp, Homo sapiens
  misc_feature: HIJSMM301C3WEL.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcggtttgggtggttcggcggagggaccaagttgaccgtctaggtcagcccaaggctcgccccctcggtcacttcc

SEQ ID NO: 781523 - DNA, 512 bp, Homo sapiens
  misc_feature: HIJSMM301AH9JW.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcgggacgggaccaaaactcgaccgtcctaggtcagacccaaggcctcgcccccgtcc

SEQ ID NO: 781524 - DNA, 483 bp, Homo sapiens
  misc_feature: HIJSMM301C4LRV.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggacccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgttggttttggcttgttcggcggcgggac

SEQ ID NO: 781525 - DNA, 496 bp, Homo sapiens
  misc_feature: HIJSMM301ELFFN.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactggcatctacccgggaatccggggtccctgaccgattcagtggcagcgggtctgggacagatttcactctcaccatcagcagcctgcaggctgaagatgtggctagtttattattgtcaacaatattattattacttcgtggacgttcgccaaggaccaaggtggatatcagacgaacgtgtggcgtg

SEQ ID NO: 781526 - DNA, 522 bp, Homo sapiens
  misc_feature: HIJSMM301CQV2U.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagtattttcgaagactccctggggttcccctttcggttttctggctccatcgacagtccctccaactccgcctcccttaccatatctgggctgaagagtgaggacgaggctgactacttctgtcagtcttatgatataaacaattatgtgattaattggcggagggaccgagggtcgaccgtccgtaggtcacgccctaaggcctcgccccctcggtcgactcc

SEQ ID NO: 781527 - DNA, 484 bp, Homo sapiens; identical to SEQ ID NO: 738391
  misc_feature: HIJSMM301AW9ZI.22.59.F04.1.454.light.4.raw

SEQ ID NO: 781528 - DNA, 509 bp, Homo sapiens; identical to SEQ ID NO: 767153
  misc_feature: HIJSMM301BRQ66.3.79.H02.1.454.light.4.raw

SEQ ID NO: 781529 - DNA, 501 bp, Homo sapiens
  misc_feature: HIJSMM301DZ1BR.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactcggcctccacggtacacttttggccaggggaccaagctggagatacaaacgaactgtaggctgcaccagtctgtt

SEQ ID NO: 781530 - DNA, 495 bp, Homo sapiens
  misc_feature: HIJSMM301AD7O5.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagatttgctaacttactattgtcaacgacggctaactagtttaccccgctccaccgttcgggcgggggaccggaaggtaggagatacaaacgaactgtaggtcgtgcaccat

SEQ ID NO: 781531 - DNA, 530 bp, Homo sapiens
  misc_feature: HIJSMM301ETMRG.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctggaccgtcctaggtcacgacccaaggctcgccccctcggtccactctgttccccgccctccc

SEQ ID NO: 781532 - DNA, 520 bp, Homo sapiens
  misc_feature: HIJSMM301BG77P.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgacccatctctgggctccaggctgaggacgaggctgattattactgcaactcacttacaacgaccgacacttgcgtattcggcggcgggaccaagactgaccgtcctaggtcagcccaaggctgccccctcggtcactctgttccccg

SEQ ID NO: 781533 - DNA, 495 bp, Homo sapiens
  misc_feature: HIJSMM301CJ00I.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgaggggtggaggatcgagacgaactgtggctgcaccatctgtt

SEQ ID NO: 781534 - DNA, 504 bp, Homo sapiens
  misc_feature: HIJSMM301BTYVB.2.35.D02.1.454.light.4.raw
  modified_base (465)..(465): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgatttattactgcagctcatatgcaggcagcagcaatgtacttttcggcggaggaccaagcngaccgtcctggtcagcccaaggctcgccccctcggtcta

SEQ ID NO: 781535 - DNA, 497 bp, Homo sapiens
  misc_feature: HIJSMM301C1MNW.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgctaacttacttactgtcaacagagttaccacgtacccccctcactttcggcggacgggaccgaaggcggagatcgaagacaactgtggctgcaccatctgtcttcta

SEQ ID NO: 781536 - DNA, 527 bp, Homo sapiens
  misc_feature: HIJSMM301AK4VB.27.23.C01.1.454.light.4.raw
  modified_base (486)..(486): a, c, t, g, unknown or other
  modified_base (495)..(495): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgtttcgggcgggagggaccaggctgaccgtcctaggtcngccaaggcncgccccctcggtccactctcgttcccaccctt

SEQ ID NO: 781537 - DNA, 487 bp, Homo sapiens
  misc_feature: HIJSMM301BGBCN.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcgagggtggaggctgaggatgtcggggtttactactgcatgcaggtacgactctggccgttcaattttcggccgaggggaccaaactggatatcagacgaactgg

SEQ ID NO: 781538 - DNA, 526 bp, Homo sapiens
  misc_feature: HIJSMM301C7F0W.9.86.H09.1.454.light.4.raw
tgatacgtctcacgaccggtgctcgatttagtgctatagacttggggtttggggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctcgttccccaccctcctacc

SEQ ID NO: 781539 - DNA, 494 bp, Homo sapiens
  misc_feature: HIJSMM301CJTD7.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccacggggaccaagctggagatcaaacgaactgtggctgcaccatcgttcg

SEQ ID NO: 781540 - DNA, 506 bp, Homo sapiens
  misc_feature: HIJSMM301EJ6Y6.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccggtgacgttcggccgaagggaccgagggtggaaatacgaaacgaactgtggctgcaccactctcgtcttcattccccg

SEQ ID NO: 781541 - DNA, 515 bp, Homo sapiens
  misc_feature: HIJSMM301AL45P.17.2.A02.1.454.light.4.raw
cgtagactagcacgaccggtgctcgatttagactcatctacaggggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggccccaaactcgtcatgtataattatagtcagcggccctcacggggtccctgaccgattcgctggctccaactctggcacctcagcctccctggccatcagtgggctccagtctgaggatgaggctgattattactgtgcagcatgggatgcagcctgagtagtcccgtcttcggaactcggggaccaaggtcaccgtcctacgtcagcccaaggccaaccccactgtcactctcgttcccgccctt

SEQ ID NO: 781542 - DNA, 492 bp, Homo sapiens; identical to SEQ ID NO: 613420
  misc_feature: HIJSMM301DNZA8.47.55.E11.1.454.light.4.raw

SEQ ID NO: 781543 - DNA, 462 bp, Homo sapiens
  misc_feature: HIJSMM301B5SUZ.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctacaatttcggcctgggaccagagtggacatgaaacgaa

SEQ ID NO: 781544 - DNA, 485 bp, Homo sapiens
  misc_feature: HIJSMM301EPSH5.49.45.E01.1.454.light.4.raw
agtcgagagacacgaccggtgctcgatttagtgagtcagtaagggaaaggggcagacccagtcaggacacagcatggacatgagggtccccgctcagctcctggggctcctgctgctctggctcccaggtgccaaatgtgacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtgggggtcccatcaagattcagcggcaatggatctgggacagaattcactctcaccattagcagcctgcagcctgatgatcttgcaactttatacttgccaacattataatagttaatatagtacattttaggcctaggggaccaagttggaagatcaaaccgaactatggctgcacat

SEQ ID NO: 781545 - DNA, 510 bp, Homo sapiens
  misc_feature: HIJSMM301E0TWI.10.27.C05.1.454.light.4.raw
catagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttctaaggttttcggcggagggaccgaggctgaccgtcctaagtcagcccaaggctcgccccctcggt

SEQ ID NO: 781546 - DNA, 494 bp, Homo sapiens
  misc_feature: HIJSMM301B2CVD.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggacaagctgaccgtcctaggtcagcccaaggctgccccctcggtcactctgttccccaccctcctcgctacgtaga

SEQ ID NO: 781547 - DNA, 488 bp, Homo sapiens
  misc_feature: HIJSMM301A25DO.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctccaccttcgggccaagggacacgactggagaattaaacgaactgtggctgcaccat

SEQ ID NO: 781548 - DNA, 486 bp, Homo sapiens
  misc_feature: HIJSMM301A8O0I.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctcgcccccaaccttcggccaggggacacgactggagattaaacgaactgtgctgcaccatctgtt

SEQ ID NO: 781549 - DNA, 496 bp, Homo sapiens
  misc_feature: HIJSMM301BS7C1.43.28.C06.1.454.light.4.raw
tgtgagtagtcacgaccggtgctcgatttagagctcacgtattggggtttggggtgactgatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggtaatttattactgcatgcaatcttcacactggcctccgtacacttttggccagggaccaagctggagatcaaacgaactgt

SEQ ID NO: 781550 - DNA, 519 bp, Homo sapiens
  misc_feature: HIJSMM301ESZRG.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggcctcgccccctcggtccactctcgttcccccg

SEQ ID NO: 781551 - DNA, 520 bp, Homo sapiens
  misc_feature: HIJSMM301BAI68.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactattctgtcaagtgtgggacaccaacacttgtgtcttcgggactgggaccgaggtcaccgtcctaagtcagcccagggccaacccccactgtcactctcgttcccaccctcctcgacaccg

SEQ ID NO: 781552 - DNA, 502 bp, Homo sapiens
  misc_feature: HIJSMM301B7NJV.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggcctcagggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcaggtcagcccaaggccaaccccactgtca

SEQ ID NO: 781553 - DNA, 487 bp, Homo sapiens; identical to SEQ ID NO: 632220
  misc_feature: HIJSMM301A07RH.26.23.C01.1.454.light.4.raw

SEQ ID NO: 781554 - DNA, 493 bp, Homo sapiens
  misc_feature: HIJSMM301AHFWM.22.65.F10.1.454.light.4.raw
  modified_base (485)..(485): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgactccaccttcggccaagggacacgactggagattaaacgaactgtggctgcaccatctntcttcatt

SEQ ID NO: 781555 - DNA, 559 bp, Homo sapiens
  misc_feature: HIJSMM301APFP1.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccacgcctgaggacgaggctgattattattgtagttcatatacaaccagtgacacgttgggtggttcggcgggtaggggaccacgggacttggacccgttccgtaagggttccacggcccccaaagggcctcggccccccttccgggtcctacctcttcgttccccaccccc

SEQ ID NO: 781556 - DNA, 537 bp, Homo sapiens
  misc_feature: HIJSMM301ERAGA.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgatttaacttgcaggtcgatatacaatacagacaacaacttattagttcttcgggtacgtagggaccgaaagaagtcaccgtccccttacggttcgacgacccaaccggacccgaaaccccccaacctcgttca

SEQ ID NO: 781557 - DNA, 492 bp, Homo sapiens
  misc_feature: HIJSMM301D27WQ.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtagaagtccaggcagaagatgaggctgactattattgtcaatcaacagacagtagtgggaaatatgtggtattcgggcggagggaccaaacgtgaccgtccgtaggtcagcccaaggcctcgtccccccg

SEQ ID NO: 781558 - DNA, 511 bp, Homo sapiens
  misc_feature: HIJSMM301BBVFZ.43.23.C01.1.454.light.4.raw
tgtgagtagtcacgaccggtgctcgatttagtacacgtgattagggattggggtggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgtctcaccct

SEQ ID NO: 781559 - DNA, 500 bp, Homo sapiens
  misc_feature: HIJSMM301CBI5U.4.39.D06.1.454.light.4.raw
  modified_base (382)..(382): a, c, t, g, unknown or other
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaaattcataatttatgaggtcactaagcggccctcaggggtccctgatcgcttctctgcctccaaggctggcaacacggcctccctgaccgtcnctgggctccaggctgaggatgaggctgattattattgcagctcatatgcaggcagttacaatgtgatattcggcggaggacaaactgaccgtcctaggtcagccaaggctgccccctc

SEQ ID NO: 781560 - DNA, 512 bp, Homo sapiens
  misc_feature: HIJSMM301EMPNB.48.59.F04.1.454.light.4.raw
agtatacatacacgaccggtgctcgatttagtacacacacttagggattggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagtattttgcagtgttattactgtcagcagtatggtagctcaccgatcaccttcggaccaagggacacgacgtggaagacttaaaccgtaactagtggctgcaccatcctagttctta

SEQ ID NO: 781561 - DNA, 509 bp, Homo sapiens
  misc_feature: HIJSMM301BKBRR.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctggggacttcgttcactctcaccatcaataacctgcaatctgacgactttgcagtttatttctgtcagcagtctgaagactggccgttctactttcggcggagggaccaaggtggacctacaaacgaactgtggctgcaccgatctgtcttcatcttcccgcc

SEQ ID NO: 781562 - DNA, 486 bp, Homo sapiens
  misc_feature: HIJSMM301DVCOW.4.34.D01.1.454.light.4.raw
agcactgtagcacgaccggtgctcgatttagatcgtctgtgttggggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccaggggccactggtatcccagccaggttcagtgccagtgggtctgggacagagttcactctcaccatcagcagcctgcagtctgaagattttgcggtttattactgtcagcagtaatgataactggctgtacacttttggccaggggaccaagctggagatcgagcgaactgtggctgcaa

SEQ ID NO: 781563 - DNA, 467 bp, Homo sapiens; identical to SEQ ID NO: 538551
  misc_feature: HIJSMM301DT2BH.48.23.C01.1.454.light.4.raw

SEQ ID NO: 781564 - DNA, 455 bp, Homo sapiens; identical to SEQ ID NO: 650480
  misc_feature: HIJSMM301B6H55.19.86.H09.1.454.light.4.raw

SEQ ID NO: 781565 - DNA, 475 bp, Homo sapiens
  misc_feature: HIJSMM301CZN3V.12.51.E07.1.454.light.4.raw
  modified_base (399)..(399): a, c, t, g, unknown or other
  modified_base (409)..(409): a, c, t, g, unknown or other
  modified_base (415)..(415): a, c, t, g, unknown or other
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctcaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgacttgnaactatactncaacanataatagttatgaatctacttagttcacggaacgaacgacagagagtcaagaaccaagtg

SEQ ID NO: 781566 - DNA, 497 bp, Homo sapiens
  misc_feature: HIJSMM301A5UQC.4.34.D01.1.454.light.4.raw
agcactgtagcacgaccggtgctcgatttagatcgtctgtgttggggtttggggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagtattttgtcggtttattactgtctagctagtatgtataacgtggctgtactacttttcggccgaggggaaccaagactggagatcaggcgaactgtggctgcacc

SEQ ID NO: 781567 - DNA, 496 bp, Homo sapiens
  misc_feature: HIJSMM301BTF8E.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccgaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccacgcctgcagtctgaagattttgcagtctattactgtcagcaatataattactggctctcttcggcgggggaccaagctggagatcaaccgaactgtggctgcaccatctgtt

SEQ ID NO: 781568 - DNA, 488 bp, Homo sapiens
  misc_feature: HIJSMM301BX5US.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaggctgccccctcggcactctcgttcccgccctcctc

SEQ ID NO: 781569 - DNA, 513 bp, Homo sapiens
  misc_feature: HIJSMM301ALZ91.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcacgtccccatgtgatcgttcgggcggggggaccgagctgaccgtcctaggtcagcccgaaggctcgtccccccg

SEQ ID NO: 781570 - DNA, 509 bp, Homo sapiens
  misc_feature: HIJSMM301EH91Y.18.78.H01.1.454.light.4.raw
tacgagtatgcacgaccggtgctcgatttagtgtgagtagtttggggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcaatcgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtcctaggtcagcccaaggccaacccccactgtca

SEQ ID NO: 781571 - DNA, 487 bp, Homo sapiens
  misc_feature: HIJSMM301D0L3B.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcacgcctccctggtcatcgcgtgggctccaggctgacgatgaggctgattattatttgccagtcctatgacaacaccctgcgtggttttggtctgttcggtcgggcgggacc

SEQ ID NO: 781572 - DNA, 490 bp, Homo sapiens
  misc_feature: HIJSMM301CKWQ6.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagattcactctcaccatcaccaacctcgcaccctgaagatggttggaagttattactgtcagacctatagtcggtcggcccgctctattttcgggcggtagggaccaagggtgcgagatacaaacgacttagtggc

SEQ ID NO: 781573 - DNA, 495 bp, Homo sapiens
  misc_feature: HIJSMM301A11ZO.22.29.C07.1.454.light.4.raw
acatacgcgtcacgaccggtgctcgatttagagtgctacgaagggaaagggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgctagtttattactgtcagcagtataattactggcctcggacgtcggccgaagggaccaggtaggaagtacaaacgaactgtggcgtgcaccatctgtctt

SEQ ID NO: 781574 - DNA, 515 bp, Homo sapiens
  misc_feature: HIJSMM301AWD6B.5.14.B03.1.454.light.4.raw
atcagacacgcacgaccggtgctcgatttagtgtgagtagttcccgggcacgaccggtgctcgatttagtagtgtagattccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacacgcccccaaactcatcctttatgatgtccgtgttcggccctcagggtttctgttcgcttctctggctccaagtctggcagcacggcctccctgaccatctctgggctccaggctgaggacgaggctgtactattattgctagttcattatggttagtatagaagacttcttgtgtagttttcgggcgggacgggaaccg

SEQ ID NO: 781575 - DNA, 494 bp, Homo sapiens
  misc_feature: HIJSMM301EBTB1.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccaggaaagcccctaagctcctgatctatgctgcatccagtttgcaaagtggggtcccatcaaggttcagtggcagtggatctgggacagatttcactctcaccatcaacagtctgcaacctgaagattttgactaacttactactgtcaacagagtttcactacccctctcctacgtttcggtccgggggaccgaacggtggagatacaaacgaactagtggctgtcaccta

SEQ ID NO: 781576 - DNA, 497 bp, Homo sapiens; identical to SEQ ID NO: 547847
  misc_feature: HIJSMM301BK7DV.22.27.C05.1.454.light.4.raw

SEQ ID NO: 781577 - DNA, 506 bp, Homo sapiens
  misc_feature: HIJSMM301D0IDA.10.37.D04.1.454.light.4.raw
catagtagtgcacgaccggtgctcgatttagtagcatactgttgggtttgggggctctgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccggtggacgttcggccaagggaccaaggtcggacctacaaacgaactgtggctgcaccatcttcg

SEQ ID NO: 781578 - DNA, 525 bp, Homo sapiens
  misc_feature: HIJSMM301AM2FO.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgactacttgggtggttcgggcggagggaccaggctgaccgtcctaggtcagcccaaggctcgcccctcggtcactctgttcccgccct

SEQ ID NO: 781579 - DNA, 513 bp, Homo sapiens
  misc_feature: HIJSMM301CBXI3.48.41.D08.1.454.light.4.raw
agtatacatacacgaccggtgctcgatttagtcacgcgagaaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggctagtttattactgtcaacaatattattatactccgaccgacggttcggccggggaccgaacgtaggaaactacaaacgaactagtggctgcaccatctgtt

SEQ ID NO: 781580 - DNA, 488 bp, Homo sapiens
  misc_feature: HIJSMM301EA6L3.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctgattgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtcccaagtaacttttggccaggggaccaagctaggagatacaaacgaactgtggctgcacc

SEQ ID NO: 781581 - DNA, 490 bp, Homo sapiens
  misc_feature: HIJSMM301B1G9I.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtgggtcccatcaagattcagtggcggtggatctgggacagatttcactctcaccatcaacagtctgcagattgaggattatgctaacttattactgtcagcagagttccacggaccccgctccacgtttcgggcggggggaccaaagtggacgtcaaacgaactgtggctgcaccta

SEQ ID NO: 781582 - DNA, 508 bp, Homo sapiens
  misc_feature: HIJSMM301BKJTS.48.37.D04.1.454.light.4.raw
agtatacatacacgaccggtgctcgatttagtagcatactgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcaggagggaccaagctgaccgtctaggtcagcccaaggctcgccccctcggt

SEQ ID NO: 781583 - DNA, 512 bp, Homo sapiens
  misc_feature: HIJSMM301B2OIP.16.46.E02.1.454.light.4.raw
tgtactactccacgaccggtgctcgatttagactcatctacagggaaaggggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatcctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgatttagttactgcagcttatatacaggcaacaattacttttgtcttcggaactgggaccaggtcacgtcctggtcagcccaaggccaacccatgtcactctccg

SEQ ID NO: 781584 - DNA, 489 bp, Homo sapiens
  misc_feature: HIJSMM301AHZN9.41.68.G02.1.454.light.4.raw
tctatactatcacgaccggtgctcgatttagtcgatagtgaagggaaagggcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcagggtcccatcaaggttcagtggaagtggatctgggacagattttactttcaccatcaccagcctgcagcctgaagatattgcaacatattactgtcaacagtatgataatctccctcccacctttcggcggaggacc

SEQ ID NO: 781585 - DNA, 501 bp, Homo sapiens
  misc_feature: HIJSMM301CKKPC.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactggaccaaggtcaccgtctaggtcagcccaaggacccaaccc

SEQ ID NO: 781586 - DNA, 514 bp, Homo sapiens
  misc_feature: HIJSMM301BHW9L.17.41.D08.1.454.light.4.raw
cgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagttgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaattatggtggtaccacccctcactttcggcggaggggccaaggtggagatcaagcgaactgtggctgcacctatctgtcttcattcttcccg

SEQ ID NO: 781587 - DNA, 487 bp, Homo sapiens
  misc_feature: HIJSMM301EKFZM.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgagcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcacca

SEQ ID NO: 781588 - DNA, 508 bp, Homo sapiens
  misc_feature: HIJSMM301AK5WZ.51.26.C04.1.454.light.4.raw
cgatcgtatacacgaccggtgctcgatttagtctagcgactttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaaagccgggcccaggcccctgtgttggtgatgtataaagacactgagaggccctcagggatccctgagcgattctctggctccaggtcagggacaacggtcacattggccatcagtggagtccaggcagaggacgaggctgactattattgcaatcaacagacaccattggtacttatgttcttcggaactgcgaccaaggtccaccgtcctgggtcacgacccaaggcccaaccccactgtcactcttccg

SEQ ID NO: 781589 - DNA, 523 bp, Homo sapiens
  misc_feature: HIJSMM301BHFYN.27.23.C01.1.454.light.4.raw
  modified_base (227)..(227): a, c, t, g, unknown or other
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgactacttgggtgttcggcggagggaccaggctgaccgtcctaggtcagcccaaggcctgccccctggtcactctcgttcccaccct

SEQ ID NO: 781590 - DNA, 492 bp, Homo sapiens
  misc_feature: HIJSMM301A1HX7.26.37.D04.1.454.light.4.raw
  modified_base (467)..(467): a, c, t, g, unknown or other
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcacttcgcggagggaccgaaggttgagatanaaacgaaactagtggcgtcgcacca

SEQ ID NO: 781591 - DNA, 513 bp, Homo sapiens
  misc_feature: HIJSMM301BNGPW.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggttggttcgggcgggggaccaaggctggaccgtcctacggtcagcccaaggcctcgccccctcggtccgactcttccg

SEQ ID NO: 781592 - DNA, 488 bp, Homo sapiens
  misc_feature: HIJSMM301CCY3W.5.41.D08.1.454.light.4.raw
atcagacacgcacgaccggtgctcgatttagtcacgcgagaaagggaaaggggggatcaggactcctcagttcaccttctcacaatgaggctccctgctcagctcctggggctgctaatgctctgggtctctggatccagtggggagattgtgctgactcagtctccactctccctgtccgtcacccctggagagccggcctccatctcctgcaggtctagtcagagcctcctgcatagtaatggattcaacttatttggattggtacctgcagaggccagggcagtctccacagctcctggtctatttgggctcttatcgggcctccggggtccctgagaggttcagtggcagtggatcaggcacagactttacactgcgaatcagcagagtggaggctgaggatggttggggtttattacgtgcatgcgaagctctacaaaccctattcactttcggccctgggaccagagtggatatacaacgaa

SEQ ID NO: 781593 - DNA, 535 bp, Homo sapiens
  misc_feature: HIJSMM301CDXXC.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaacgcggggacccagaccctggagcctcagttggaagcagccgatccagcctggccggagccctggtggggcagggtccaggcccaaggctcggccccctcgggtccactctacgttccccaccctcctcaaccgg

SEQ ID NO: 781594 - DNA, 497 bp, Homo sapiens
  misc_feature: HIJSMM301AS5DF.40.54.E10.1.454.light.4.raw
tctagcgactcacgaccggtgctcgatttagatcgtagcagaacacacaaagggggctgtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccagcatcacctgctctggagattcattgtcaaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccgaggcagaagacgaggctgactattactgtacaatcagcagacagacagtggttactttttcggggtttcggacgggagggaccaagctgaccgtcctaggtcagcccaaggc

SEQ ID NO: 781595 - DNA, 504 bp, Homo sapiens
  misc_feature: HIJSMM301BT568.53.22.B11.1.454.light.4.raw
cgcgtatacacacgaccggtgctcgatttagacgacagctcagggggtggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagaggccctcagggatccctgagcgattctctggctccaggtcagggacaacggtcacattggccatcagtggagtccaggcaggaggacgaggctgactattattgtacaatcaacagacaccattggtacttatgtcttcggaactgacgaccaaggtcaccgtccgtgggtcacgcccaaggcccaaccccactgcctactcttccg

SEQ ID NO: 781596 - DNA, 511 bp, Homo sapiens
  misc_feature: HIJSMM301APK1Z.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtccactctgtttccca

SEQ ID NO: 781597 - DNA, 508 bp, Homo sapiens
  misc_feature: HIJSMM301CHPQM.43.22.B11.1.454.light.4.raw
tgtgagtagtcacgaccggtgctcgatttagacgacagctcaggggtctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaataattttgtttcctggtaccagcaactcccaggaacagcccccaaactcctcatttatgacagtaataggcgaccctcagggattcctgaccgattctctggctccaagtctggcacgtcagccaccctgggcatcaccggactccagactggggacgaggccgattattactgcggaacatgggacagcagcctgaattacgttgggtgttcgggcggagggaccaggctgaccgtctaagtcagcccaaggctcgccccctc

SEQ ID NO: 781598 - DNA, 484 bp, Homo sapiens; identical to SEQ ID NO: 535240
  misc_feature: HIJSMM301D1577.47.60.F05.1.454.light.4.raw

SEQ ID NO: 781599 - DNA, 513 bp, Homo sapiens
  misc_feature: HIJSMM301B8L7I.9.21.B10.1.454.light.4.raw
tgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgccccacactcttaattatgaggtcactaagcggccctcaggggtttctggtcgcttctctgcctccaagtctggcaacacggcctccctgacaatctctgggctccagtctgacgacgaggctgattattactgcagctcatatgcagttggttccttcgtttacaagatagttcgcgggagggaccaggctgaccgtccttgagtcacgcccaagggctcgtccccccg

SEQ ID NO: 781600 - DNA, 494 bp, Homo sapiens
  misc_feature: HIJSMM301EDNUF.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcaagcagagtggaggctgaggatggttgggctctattattgcatgcaagctctacaacgtcccgctcactttcggcggtagggaccgaaggtggagatacgaaacgaactt

SEQ ID NO: 781601 - DNA, 478 bp, Homo sapiens
  misc_feature: HIJSMM301CMLA1.41.34.D01.1.454.light.4.raw
tctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattaactgccaacactatcgatagttaccgctcactttcggcggaggaccaaggtgaggtcaagcgaactgtggctgcaccat

SEQ ID NO: 781602 - DNA, 507 bp, Homo sapiens
  misc_feature: HIJSMM301BJLPU.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaaccgagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtctt

SEQ ID NO: 781603 - DNA, 503 bp, Homo sapiens
  misc_feature: HIJSMM301EVA0E.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcagcagcactcaatcttcggaactgggaccaaggtcaccgtcctaggtcacgcccaaggccaaccccactgt

SEQ ID NO: 781604 - DNA, 520 bp, Homo sapiens
  misc_feature: HIJSMM301ENU31.8.23.C01.1.454.light.4.raw
ctcgcgtgtccacgaccggtgctcgatttagtacacgtgattagggattgggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagcccggtgatgaggctgacttatttttgtcaggtgtgggacagcagcatttatgtcttcggactgggaccaaggtcaccgtcctaggtcagcccaaggccaaccccactcgtcactctcgttcccgccctcctcgacc

SEQ ID NO: 781605 - DNA, 505 bp, Homo sapiens
  misc_feature: HIJSMM301BMGD5.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacggggcatccctgacagattcagtggcagtgggtccgggtcagactatctgctcaccatcgacggtctggaacctgaagattctgcactatattactgtcagctttatgttaattcacctccgtcgtactatctttggcctaggggaccaagctggagatacaaacgaactggtgctgcaccatctgtcttcatttccc

SEQ ID NO: 781606 - DNA, 520 bp, Homo sapiens
  misc_feature: HIJSMM301D8PXH.14.19.B08.1.454.light.4.raw
cgtctagtaccacgaccggtgctcgatttagtgagtcagtaagggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagccctccctggccatcagtgggctccggtccgaggatgaggctgattattactgtgcagcatgggatgacagcctgagtggtccgttgggtgttcggcggagggaccaagctgaccgtcctagtcagcccaaggctcgccccctcggtcactctcgttcccaccctcctccg

SEQ ID NO: 781607 - DNA, 463 bp, Homo sapiens; identical to SEQ ID NO: 586110
  misc_feature: HIJSMM301CRN59.40.2.A02.1.454.light.4.raw

SEQ ID NO: 781608 - DNA, 517 bp, Homo sapiens
  misc_feature: HIJSMM301B2SWX.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgacctagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctccgctgcttggtcgttttcggcggtaggggaccaagctgaccgtcctcgggtcgagcccaaggctcgccccctcggtctaccg

SEQ ID NO: 781609 - DNA, 512 bp, Homo sapiens
  misc_feature: HIJSMM301E3184.3.33.C11.1.454.light.4.raw
agacgcactccacgaccggtgctcgatttagagtgagctcgttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaacccagcagtgacattggtgattataactatgttctcctggtaccagcagcacccaggcaaagcccccaaactcatcatttatgatgtcactgctcggccctcaggggtttctcatcgcttttctggctccaagtctggcaccacggcctccctgaccatctcgggctccaggctgaggacgaggctgcttattactgcagctcatatacaaggggcaccactcttccgtggtagtttggtggagggaccaagctgaccgtccgtacggtcagcccaaggctcgccccccg

SEQ ID NO: 781610 - DNA, 491 bp, Homo sapiens
  misc_feature: HIJSMM301CSVF1.3.29.C07.1.454.light.4.raw
agacgcactccacgaccggtgctcgatttagagtgctacgaagggaaagggggaggagtcagtcccaaccaggacacagcatggacatgagggtccctgctcagctcctggggctcctgctgctctggctctcaggtgccagatgtgacatgcagatgacccagtctccctcctccctgtctgcatctgtgggagacagcgtcaccatcacttgccaggcgagtcaggacattagcacctatttaaattggtatcaacagaagccagggaaagcccctaaagtcctaatatatgatgcatccaagttgcaaacaggggtcccatccaggttcaggggaggtggatctgggacacactttactctcaccatcagcagcctgcagcctgaagatttgcaacatatttttgtcaacattatgacaatcgttccccccgtactacttttgggccaggggaccaaggtggagatcaaacgaactgtaggctgcacc

SEQ ID NO: 781611 - DNA, 497 bp, Homo sapiens
  misc_feature: HIJSMM301CMAQP.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggcttactttattttgctgtctcttatgcaggctagtttcgctctcgagttgtcggcggaggaccgagctcgaccgtcctacgtcacgccca

SEQ ID NO: 781612 - DNA, 514 bp, Homo sapiens
  misc_feature: HIJSMM301DRYBV.48.38.D05.1.454.light.4.raw
agtatacatacacgaccggtgctcgatttagtatctgatagttggggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctcctgacaatctctgggctccaggctgagggacgaggctgattattattgctgctacatatgcgaggtggtactacgttggggtgttcggcaggagggaccaagcctgaccgtccgtaggtccagcccaaggcctcgtccccccg

SEQ ID NO: 781613 - DNA, 510 bp, Homo sapiens
  misc_feature: HIJSMM301EZQN9.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagctgcaggctgaagatgtggcagttattattgtcagcaatattatattcctccttcagacgttcggcccaagggacccaaaggtggaaattcaaaacgaaacctcgtagggcttagctaccaa

SEQ ID NO: 781614 - DNA, 521 bp, Homo sapiens
  misc_feature: HIJSMM301DAI1W.43.24.C02.1.454.light.4.raw
tgtgagtagtcacgaccggtgctcgatttagtacagatcgttagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacaccggcctccctcgaccatctctgggctccaggctgaggacgaggctgattattactgcaactcacttacaacgaccgacacttgcgtattcggtcggcgggaccaagctgaccgtcctaggtcagcccaaggctgccccctcggtccactcttccg

SEQ ID NO: 781615 - DNA, 488 bp, Homo sapiens
  misc_feature: HIJSMM301DNWMO.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagtatttgcagtttattactgtcagcagtatcatgactggccgctcaccttcgggaccaagggacacgacgtggaagattaaacgaactgtggctgcaccat

SEQ ID NO: 781616 - DNA, 499 bp, Homo sapiens
  misc_feature: HIJSMM301EKTZV.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttaataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatataacaagcacagccactctctatgtcttacggaactgggaccaaggtcaccgtcctagtcagcccaagg

SEQ ID NO: 781617 - DNA, 509 bp, Homo sapiens
  misc_feature: HIJSMM301DA4RF.4.57.F02.1.454.light.4.raw
agcactgtagcacgaccggtgctcgatttagctcgatatagttgggtttgggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaaggccggggatgaggccgactattactgtcaggtgtgggatagtagtggtgatcatccatacgtcttcggaacgtgggaccaaggtctccgtcctacgtcagcccaaggcccaactccactgtcacct

SEQ ID NO: 781618 - DNA, 519 bp, Homo sapiens
  misc_feature: HIJSMM301BPMQZ.15.76.G10.1.454.light.4.raw
  modified_base (458)..(458): a, c, t, g, unknown or other
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctacttctacttggtggtgctgtgctattcggcggagggaccaagctgaccgtnttaagtcagcccaaggctcgccccctcggtcactctcgttcccgccctcctcgcttaacgg

SEQ ID NO: 781619 - DNA, 491 bp, Homo sapiens
  misc_feature: HIJSMM301BUI1F.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcaggaggacgaggctgactattattgtctaatcagcagacaacagtaatacttatctttatgttcttcggatctgggaccagggtccaccgtcctaggtcacgcccaaggcccaaccc

SEQ ID NO: 781620 - DNA, 493 bp, Homo sapiens
  misc_feature: HIJSMM301B4R03.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcgggtagggaccgagggtggagatcaaacgaactgtggctgcaccatctgtcttc

SEQ ID NO: 781621 - DNA, 518 bp, Homo sapiens
  misc_feature: HIJSMM301ALT8N.9.53.E09.1.454.light.4.raw
tgatacgtctcacgaccggtgctcgatttagagagagtgtgttggggtttgggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggcttgattattactgctgctcatatgcaagatggtgactactccccgtgggtattcgggcggacgggaccaaggtcgaccgtcccaggtcacgcccaaggcctcgtccccccg

SEQ ID NO: 781622 - DNA, 524 bp, Homo sapiens
  misc_feature: HIJSMM301D3RWK.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggtcggagggtaccagggtgaccggtcctaaggtcagcccaaggctgccccctcggtcactctcgttcccta

SEQ ID NO: 781623 - DNA, 486 bp, Homo sapiens
  misc_feature: HIJSMM301AUMOY.18.76.G10.1.454.light.4.raw
  modified_base (442)..(442): a, c, t, g, unknown or other
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtccagcatctgtaggagacagagtcaccatcacttgccaggcgagtcaagacactgacaagtttgtgaattggtatcagcagaaaacagggacagcccctaagctcctaatctacgatgcgtctctatttgcagacacggggtcccaccaaggttcagcggaagtggatctgggacagtattttaatttacaccatcagcacgcctccaacgtgatgatgttgcaacatactattgtcagcaatatgtattttgtctcctccgagtcncctcgtttagggtcggggggaccgaaggtggacatacaaacgaa

SEQ ID NO: 781624 - DNA, 489 bp, Homo sapiens
  misc_feature: HIJSMM301DZLZ0.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccggtggaggctgaggacgttggaatttattactgtatgcaaggtatagagcttcctccgtacgttcggccaagggaccgaaggtggaactacaaacgaa

SEQ ID NO: 781625 - DNA, 389 bp, Homo sapiens; identical to SEQ ID NO: 561342
  misc_feature: HIJSMM301D2VX3.12.6.A06.1.454.light.4.raw

SEQ ID NO: 781626 - DNA, 496 bp, Homo sapiens
  misc_feature: HIJSMM301BKEBN.14.53.E09.1.454.light.4.raw
cgtctagtaccacgaccggtgctcgatttagagagagtgtgttgggtttgggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgatttatatataaggacactgagaggccctcaggggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggt

SEQ ID NO: 781627 - DNA, 482 bp, Homo sapiens
  misc_feature: HIJSMM301EDG2H.52.69.G03.1.454.light.4.raw
cgcagtacgacacgaccggtgctcgatttagtcgctgcgtaaaggagaaaggggagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaagaaccggggagagcccctaaactcctgatccatactgcatccactttgcatgctggggtcccattcagggttcggcggcagtggatctgggacagaattcactctcacaatcagcagcctgcagactgaagactccgcaatttattactgtcaacaacgtcaccgttacccgatcacttcgccaagggcacggctggagattaaacgaactgtgctgcaccatctgtt

SEQ ID NO: 781628 - DNA, 486 bp, Homo sapiens
  misc_feature: HIJSMM301D9S0O.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcgagcacctatgtggttttcggcggtagggaccgaagctgaccgtccttggtcacgcccaaggctcg

SEQ ID NO: 781629 - DNA, 502 bp, Homo sapiens
  misc_feature: HIJSMM301AWAR4.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctggacccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactc

SEQ ID NO: 781630 - DNA, 494 bp, Homo sapiens
  misc_feature: HIJSMM301ADR6B.49.20.B09.1.454.light.4.raw
agtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggctagttatgtcgtattcggcggagggactacgctgaccgtcctaggtcagcccaaggctcgccccctcggt

SEQ ID NO: 781631 - DNA, 509 bp, Homo sapiens
  misc_feature: HIJSMM301E1F1Y.22.9.A09.1.454.light.4.raw
acatacgcgtcacgaccggtgctcgatttagcgagacgcgcaggggggaggaactgctcagttaggaccccagaggggaaccatggaagcccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgctagtttattactgtcagcagcgtaccaagtcggcctccgtactttcggccgacgggggccgaagctggagatcagacgaactgtggctgcaccatctgtcttcactccttccccg

SEQ ID NO: 781632 - DNA, 502 bp, Homo sapiens
  misc_feature: HIJSMM301AO6AP.18.26.C04.1.454.light.4.raw
tacgagtatgcacgaccggtgctcgatttagtctagcgactttgggtttggggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtgggggcctcaacaaggttcagcggcagtggatctgggacagatttcactctcaccatcaccagcctgcagcctgaagattttgcaacttactattgtcaacaggctgacaggttcccgctgactttcggcggtagggaccaaggtagagatcaaaggaactgtggctcgcaccatctgtcttcatcttcccg

SEQ ID NO: 781633 - DNA, 513 bp, Homo sapiens
  misc_feature: HIJSMM301C13SP.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccgaagctgaccgtcctaggtcagcccaaggcctgccccctcggccact

SEQ ID NO: 781634 - DNA, 488 bp, Homo sapiens
  misc_feature: HIJSMM301DQGDZ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcgcggaggaccgaaggcggagatcagacgaactgtggctggcaccatctgtcttcta

SEQ ID NO: 781635 - DNA, 506 bp, Homo sapiens
  misc_feature: HIJSMM301CB2F9.3.33.C11.1.454.light.4.raw
  modified_base (487)..(487): a, c, t, g, unknown or other
  modified_base (497)..(497): a, c, t, g, unknown or other
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaacgcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaaacacttgtttttcggcgggagggaccaagctgaccgtcctaggtcacgcccaaggctcgccccctcggtccactctcgttcccnccctcctcgngtcgcgtct

SEQ ID NO: 781636 - DNA, 511 bp, Homo sapiens
  misc_feature: HIJSMM301DBY56.52.46.E02.1.454.light.4.raw
cgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaatacccggcaaagtccccaaactcatgatctttgaggtcaatgatcggcccgcaggggtttctcatcgcttctccggctccaagtctggcagcacggcctccctgaccatctctgggctccgaggctgaggacgaggctgattattactgcagctcatatacaaacagaaacacgttgggtgttcggcggcgggaccagactgaccgtcctacgtcagcccaaggctcgccccctcggtcta

SEQ ID NO: 781637 - DNA, 508 bp, Homo sapiens
  misc_feature: HIJSMM301AIZLA.21.22.B11.1.454.light.4.raw
  modified_base (48)..(48): a, c, t, g, unknown or other
tcgtcgctcgcacgaccggtgctcgatttagacgacagctcaggggancttcagctgtggtagagaagacaggactcaggacaatctccagcatggccggcttccctctcctcctcaccctcctcactcactgcgcagggtcctgggcccagtctgtgctgactcagccaccctcagcgtctgggaccccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacagtgggatgaccaatcctgaggcggttgggtggttcggacgggaggaccaaactgaccgtcctaggtcacgccc

SEQ ID NO: 781638 - DNA, 501 bp, Homo sapiens
  misc_feature: HIJSMM301DCGT4.41.14.B03.1.454.light.4.raw
tctatactatcacgaccggtgctcgatttagtgtgagtagttccgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgatttattactgcagctcatatacaagcagcagcactctcgtggtattcggcggagggaccaagctgaccgtcctaggtcacgcccaaggctccg

SEQ ID NO: 781639 - DNA, 455 bp, Homo sapiens
  misc_feature: HIJSMM301A0LQO.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttttcggcggagggaccaaggctgaccgtcctaagtcagcccaaggctgccccctcggtcactctgttcccacctcctccacgagagta

SEQ ID NO: 781640 - DNA, 386 bp, Homo sapiens
  misc_feature: HIJSMM301BXCYF.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctgttcccaccctcctccgagcga

SEQ ID NO: 781641 - DNA, 488 bp, Homo sapiens
  misc_feature: HIJSMM301CQBB1.8.53.E09.1.454.light.4.raw
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcggacaagttgaccgtctacg

SEQ ID NO: 781642 - DNA, 507 bp, Homo sapiens
  misc_feature: HIJSMM301C59O8.9.21.B10.1.454.light.4.raw
tgatacgtctcacgaccggtgctcgatttagtgtcgtcgcaggagggagggggtcacaagaggcagcgctctcgggacgtctccaccatggcctgggctctgctgctcctcaccctcctcactcaggacacagggtcctgggcccttgtctgccctgactcagcctgcctccgtgtctgggtctcctggacagtcgatcaccatctcctgcactggacccaccactgatattgggcattataaccttgtctcctggtatcaacaacgccagacaaagccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaaggataattcgggcggagggaccaggcctggacccgtcctgagtcagcccaaggcctgcccccttc

SEQ ID NO: 781643 - DNA, 523 bp, Homo sapiens
  misc_feature: HIJSMM301ADLDH.43.14.B03.1.454.light.4.raw
tgtgagtagtcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctggaggacgaggctgattattactgcaactcacttacaacgaccgacacttgcgtattcggcggcgggaccgaagctgaccgtcctaggtcagcccgaaggctcgccccctcggtccactctcgttccccta

SEQ ID NO: 781644 - DNA, 526 bp, Homo sapiens
  misc_feature: HIJSMM301DCBHY.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctacttggtgtgctgtgctattcggcggaggaccaagctcgaccgtacttaagtctacgcccaaggcctcgccccctcggtccactcctcgttccccaccctcccttaccc

SEQ ID NO: 781645 - DNA, 508 bp, Homo sapiens
  misc_feature: HIJSMM301BXNFE.43.86.H09.1.454.light.4.raw
  modified_base (423)..(423): a, c, t, g, unknown or other
tgtgagtagtcacgaccggtgctcgatttagtgctatagacttgggtttgggggatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggtttattactgcangcaaacttcacactggcctccgttctacttttgggccaggggaccaagggtggagatcaaacgaactgtggctgcaccatctgtt

SEQ ID NO: 781646 - DNA, 494 bp, Homo sapiens
  misc_feature: HIJSMM301AKNDQ.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgttggttttcggcgggagggaccaagctgaccgtccttggtccagacccaaggctcgtccccccg

SEQ ID NO: 781647 - DNA, 516 bp, Homo sapiens
  misc_feature: HIJSMM301EHJXF.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcgggaacacggccaccctgaccatcagcagggcccaacccttggatgaggtgactatttctgtcaagtgtgggacaccacacttgtgtcttcgggactgggaccgaggtcaccgtcctaagtcagcccacggccaaccccactcgtcactctgttcccaccctcctcgacacg

SEQ ID NO: 781648 - DNA, 494 bp, Homo sapiens
  misc_feature: HIJSMM301D13QF.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactaactgtcaacagagttacagtacccccctcactttcggccggagggaccgaaggcggaggatcagacgaactgtggctgcaccatcctgtcttcta

SEQ ID NO: 781649 - DNA, 516 bp, Homo sapiens
  misc_feature: HIJSMM301EGCA8.48.17.B06.1.454.light.4.raw
agtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagccccaaattaattattatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctcgcccctcggtcactctcgttcccaccct

SEQ ID NO: 781650 - DNA, 490 bp, Homo sapiens
  misc_feature: HIJSMM301BQT41.14.53.E09.1.454.light.4.raw
cgtctagtaccacgaccggtgctcgatttagagagagtgtgttgggtttgggggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcacctttgaccatcagtgcagtccaggcagaagacgaaggctgactattattgtcaatcagcagtcagcactaattcttatcgggtgttcggcggagggaccaagctgaccgtctac

SEQ ID NO: 781651 - DNA, 509 bp, Homo sapiens
  misc_feature: HIJSMM301EOQH1.12.67.G01.1.454.light.4.raw
  modified_base (400)..(400): a, c, t, g, unknown or other
atacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgtattttttgatgtcactaatcggccctcaggggtttctgatcgcttctctggctccaagtctgactacacggcctccctgaccatctctgggctccaggctgaggacgaggctgattattattgcagctcatatacaagcagcagcaccctntttgtcttcggaagtgggaccaaggtcaccgtcctacgtcagcccctaaggccctaaacccccactcggtccacttccttcgttcccccgccctcctactacgtcgtat

SEQ ID NO: 781652 - DNA, 517 bp, Homo sapiens
  misc_feature: HIJSMM301EJP78.41.78.H01.1.454.light.4.raw
tctatactatcacgaccggtgctcgatttagtgtgagtagtttgggtttgggggatagctcaggaagcagagcctggagcatctccactatggcctgggctccactacttctcaccctcctcgctcactgcacaggttcttgggcccatttttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctgggtccctttcggtttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccgt

SEQ ID NO: 781653 - DNA, 503 bp, Homo sapiens
  misc_feature: HIJSMM301EJNE8.9.81.H04.1.454.light.4.raw
  modified_base (496)..(496): a, c, t, g, unknown or other
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctcccaagtctggcaacacggcctccctgaccgtctctgggctccaggctgacgatgaggctgattattactgcagctcatatgcaggcacccaacaatgtcttcggaagtgggaccacggtcaccgtcctagtcagcccaaggccaaccccacngtcactc

SEQ ID NO: 781654 - DNA, 388 bp, Homo sapiens
  misc_feature: HIJSMM301CODEV.48.53.E09.1.454.light.4.raw
agtatacatacacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgaagaagaactacttagcttggtaccagcagagaccaggacaacctcctaagttgcttctttactggggcgtcgttcccgggagtcccggggtccctgaccgattcagtgccagcgggtctgggacagacttcactctcacca

SEQ ID NO: 781655 - DNA, 490 bp, Homo sapiens
  misc_feature: HIJSMM301CUOX9.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacaggcgcctcaggacttatgtcttcggaactgggacccacgttaccgtacctaggtcacgaccccg

SEQ ID NO: 781656 - DNA, 487 bp, Homo sapiens
  misc_feature: HIJSMM301AK0HV.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccgaggggaccaaagttgagatcaaacgaactgtggctgcaccatctgtt

SEQ ID NO: 781657 - DNA, 499 bp, Homo sapiens
  misc_feature: HIJSMM301BOOUN.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtacaaacaccttcggccaagggacacgactggagattaaaggaactgtggctcggcaccactctgtcttcatccttccccg

SEQ ID NO: 781658 - DNA, 514 bp, Homo sapiens
  misc_feature: HIJSMM301ALEF2.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctggaggacgaggcctgactattactgtcctactctactttggtggtgctgtgctattcggcggagggaccagctggacctcttaagtcagcccaaggctcgcccccgtcggtcactctcgttcccgt

SEQ ID NO: 781659 - DNA, 496 bp, Homo sapiens
  misc_feature: HIJSMM301DIQGS.22.57.F02.1.454.light.4.raw
acatacgcgtcacgaccggtgctcgatttagctcgatatagttggggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcaccttcggccaagggacacgactggagattaaacgaacttgtggctgcaccatctgtcttcatt

SEQ ID NO: 781660 - DNA, 523 bp, Homo sapiens
  misc_feature: HIJSMM301DWFKC.15.59.F04.1.454.light.4.raw
tctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaagctgccctcaccatcacgggggccccaggcagatgatgaatctgtttattattgtgtcctattatatgggtgctggctatttcggttcttcgggcgggagggaccgtaagctcgacccgtccttac

SEQ ID NO: 781661 - DNA, 497 bp, Homo sapiens
  misc_feature: HIJSMM301C7BGN.46.26.C04.1.454.light.4.raw
  modified_base (427)..(427): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaacttatttggattggtacctgcagaagccagggcagtctccacagctcatcatcttatttggttctaatcgggcctccgggtccctgacaggttcaggtggcagtggatcaggcacagtattttacactagaaaatcagcagagtggaggctgaggatgttgggctcttattattgnatgcaagctctacaacgtcccgctcactttcggcgggacgggaccgaaggtacggagatacaaacgaact

SEQ ID NO: 781662 - DNA, 490 bp, Homo sapiens
  misc_feature: HIJSMM301E34DL.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgttcagcagtatggtcacgtccccaagaacttttggccaggggaccaagctggagatcaaacgaactagtggctgcaccagt

SEQ ID NO: 781663 - DNA, 498 bp, Homo sapiens
  misc_feature: HIJSMM301CE73I.51.23.C01.1.454.light.4.raw
cgatcgtatacacgaccggtgctcgatttagtacacgtgattagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctgctccaggtcagggacaacggtcacattggccatcaggtggagtccaggcaggaggacgaggctgacttattattgtcaatcaacagacaccattggtacttatgtcttcggaactgcaccgaaggtcaccgtctggtcacgcccaaggcccaacccatcgcactcc

SEQ ID NO: 781664 - DNA, 448 bp, Homo sapiens; identical to SEQ ID NO: 709700
  misc_feature: HIJSMM301DFL7H.18.9.A09.1.454.light.4.raw

SEQ ID NO: 781665 - DNA, 498 bp, Homo sapiens
  misc_feature: HIJSMM301BBOVP.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgacgaccaaggtcaccgtcctgggtcagcccaaggcccaacccactgtcactc

SEQ ID NO: 781666 - DNA, 486 bp, Homo sapiens
  misc_feature: HIJSMM301DIVH3.3.10.A10.1.454.light.4.raw
  modified_base (416)..(416): a, c, t, g, unknown or other
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaagccaggccaggcccctgtggtggtgatatataaagacagtgagaggccctcagggatccctgagcgattctctggctccagctcgagggacaacagtcagttgaccatcagtggagtccaggcagaggacgaggctgactattattgtcaatcagcagacaanagtaatacttattctttatgtcttcggatcgtggtaccgagggtcgacccgtctacgggtcaggacccaa

SEQ ID NO: 781667 - DNA, 529 bp, Homo sapiens
  misc_feature: HIJSMM301CMYZM.27.23.C01.1.454.light.4.raw
  modified_base (451)..(451): a, c, t, g, unknown or other
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttaataactttatctgttggtaccgacaggacccaggcactgtccccaaactcattctttatgatgtcagtaatcggcccccaggggtttcctgatcgcttctatggctccaagtctgcctacacggcctccctgaccatctccgggctccagcctgaggacgaggctgattattattgtagttcatatacaaccagtgacacttgggtnttcggcggagggaccaggctgaccgtcctaggtcagcccaaggcctgccccctcggtcactctcgttcccgccttccc

SEQ ID NO: 781668 - DNA, 510 bp, Homo sapiens
  misc_feature: HIJSMM301BTJ3F.40.12.B01.1.454.light.4.raw
  modified_base (318)..(318): a, c, t, g, unknown or other
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctnaggggtccctgatcgcttctctggctccaagtctggcaacacggcctccctgaccgtctctgggctcaggctgaagatgaggctgattattactgctactcgtatgcaggcggcaacaattgggcttcggcggagggaccaagctgacgtccaggtcagcccaaggctgccccctcggtcactctgttccca

SEQ ID NO: 781669 - DNA, 497 bp, Homo sapiens
  misc_feature: HIJSMM301DK1ZF.11.57.F02.1.454.light.4.raw
cgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccacccaggttcagtggcggtgggtctgggacagtgttcactctcaccatcagcagcctgcagtctgaagtattttgctagtttattactgtcagcagtatagtagtggccgctcactttcggcggagggaccaaggtggagatcagacgaacgtgtggctgcacatccttgtcttc

SEQ ID NO: 781670 - DNA, 501 bp, Homo sapiens
  misc_feature: HIJSMM301BOV7D.47.62.F07.1.454.light.4.raw
agctcacgtacacgaccggtgctcgatttagtagtcgcataaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatcgtgggacagatttcactctcacatcagcagtctgcaacctgaagtattttgacaacttactactgtcaacagtagttaccggtaccccgtactacgttttcggccaaggggaccaaactggacactcaaaacgactagtggtactgcaccatctgtt

SEQ ID NO: 781671 - DNA, 496 bp, Homo sapiens
  misc_feature: HIJSMM301CKYAW.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagtattttgctaacttattactgtctacaagtattcttcttaccctcggacgttcggccgacgggaccgacggtggatagtcaagacgaacgtgtggctcgcaccatcttcg

SEQ ID NO: 781672 - DNA, 486 bp, Homo sapiens
  misc_feature: HIJSMM301DCP9V.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttctacacttttggccagggaccgaagctggagatcaaacaaa

SEQ ID NO: 781673 - DNA, 497 bp, Homo sapiens
  misc_feature: HIJSMM301EMGOQ.11.81.H04.1.454.light.4.raw
  modified_base (158)..(158): a, c, t, g, unknown or other
  modified_base (394)..(394): a, c, t, g, unknown or other
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgnagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcngtttttttactgtcagcagtatagtaactggcctccgtacacttttggccagggggaccaagctagaaatcaaacgaactgtggctgcaccatctgtcttcta

SEQ ID NO: 781674 - DNA, 494 bp, Homo sapiens
  misc_feature: HIJSMM301AQRP6.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgctagtttattactgtcagcagtatggtacttcacaaccttcggccaggggacacgactggagattaagcgaactgtggctgcaccatctgtctt

SEQ ID NO: 781675 - DNA, 527 bp, Homo sapiens
  misc_feature: HIJSMM301EXFXP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacacgtttttctcgggcgttcggtccgaacgggtaccgaacgggtaggaaagtacaaaacggaacctaagtggcttggcaccactctcgttcttctattccttccccg

SEQ ID NO: 781676 - DNA, 489 bp, Homo sapiens
  misc_feature: HIJSMM301AWW7R.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccgaagcgtggagatcaaacgaactagtggctgcaccat

SEQ ID NO: 781677 - DNA, 523 bp, Homo sapiens
  misc_feature: HIJSMM301EZWPV.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgactacgttgggtgttcggcgggagggaccagggctgtaccgtctaggtcagcccaggctcgcccctcgtcactctcgttcccaccct

SEQ ID NO: 781678 - DNA, 504 bp, Homo sapiens
  misc_feature: HIJSMM301CJO1W.47.83.H06.1.454.light.4.raw
agctcacgtacacgaccggtgctcgatttagatcacgtgcgtcgcgggggggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaagctgccctcaccatcgcggggcccgaggcagatgatgagtgtgtattattactgtgtgctctatagtgggcagtggtcggtttggggtgttcgggcggagggaccaagctgaccgtctaggtcagcccaggctcgccccctc

SEQ ID NO: 781679 - DNA, 506 bp, Homo sapiens
  misc_feature: HIJSMM301DMBMU.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgacccatcagcagggtcgaagccggggatgaggcgactattactgtcaggtgtgggatagtagtggtgatcatccatacgtcttcggaacttgggacaagggtctccgtcctacgtcagcccaaggccaactccactgtcactt

SEQ ID NO: 781680 - DNA, 522 bp, Homo sapiens
  misc_feature: HIJSMM301CRE8V.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcaccccggacgttcggccaacgggaccgaaggtacggaaggtacgaaacgaactagtaggtcgtgtcgaccatctgtcttcattccttcccgtcctacgt

SEQ ID NO: 781681 - DNA, 482 bp, Homo sapiens
  misc_feature: HIJSMM301AUIT0.48.5.A05.1.454.light.4.raw
  modified_base (474)..(474): a, c, t, g, unknown or other
agtatacatacacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccgaaggtaggaaatacaaacgaactagtggntgcaccat

SEQ ID NO: 781682 - DNA, 492 bp, Homo sapiens
  misc_feature: HIJSMM301CB6JE.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacggactggagattaaaggaactgtgctgcacatctgtcttcatcttcccg

SEQ ID NO: 781683 - DNA, 496 bp, Homo sapiens
  misc_feature: HIJSMM301AQR75.49.22.B11.1.454.light.4.raw
agtcgagagacacgaccggtgctcgatttagacgacagctcaggggggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactggaaattaaacgaactagtggctgcaccatctgtcttcatcttcccgccat

SEQ ID NO: 781684 - DNA, 518 bp, Homo sapiens
  misc_feature: HIJSMM301DOBFX.51.38.D05.1.454.light.4.raw
cgatcgtatacacgaccggtgctcgatttagtatctgatagttggggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaaagcccccaaactcatgatttatgatgtcagtgatcggccctcaggggtttcaatcgcttctctggctccaagtccggcaacacggcctccctgaccatctctggcctccaggccgaggacgaggctagattatactgcagctcatatacaaatcaaataacaagttggtggttcggcgggaacgggaccaaaactcgaccgtaccgtacgtgacgccaacggctcgcccctccg

SEQ ID NO: 781685 - DNA, 518 bp, Homo sapiens
  misc_feature: HIJSMM301B70C3.52.29.C07.1.454.light.4.raw
  modified_base (381)..(381): a, c, t, g, unknown or other
  modified_base (444)..(444): a, c, t, g, unknown or other
cgcagtacgacacgaccggtgctcgatttagagtgctacgaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgacattggtacttataattctgtctcctggtaccaacaataccccggcaaagtccccaaactcatgatctttgaggtcagtgatcggcccgcaggggttttctcatcgcttctccggctccaagtctggcagcacggcctccctgaccntctctgggctccaggctgaggacgaggctgattattactgcagctcatatacaaacagaaacncttagggtgttcggcggacgggaccaactgaccgtcctacgtcacgcccaaggcctcgccccctcggtccactt

SEQ ID NO: 781686 - DNA, 510 bp, Homo sapiens
  misc_feature: HIJSMM301CF0B4.8.23.C01.1.454.light.4.raw
  modified_base (481)..(481): a, c, t, g, unknown or other
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggactggaccaggtcacgtcctagtcagccaaggccaaccccnctgcactctgttcccaccctcctcgaccg

SEQ ID NO: 781687 - DNA, 489 bp, Homo sapiens
  misc_feature: HIJSMM301EHQ6Z.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctcctgaccatctctgggctccaggctggaggacgagggtgatttattactgcagctcatatagaagtggcagcactctcgtattcggcggtgggaccaagctgacgtccaggtcagccc

SEQ ID NO: 781688 - DNA, 486 bp, Homo sapiens
  misc_feature: HIJSMM301B8B28.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgatttattactgcagctcatatacagcaccagcactctctatgtcttcggaactgggaccaaggtcaccgtcctaggtc

SEQ ID NO: 781689 - DNA, 500 bp, Homo sapiens
  misc_feature: HIJSMM301EI701.40.23.C01.1.454.light.4.raw
  modified_base (458)..(458): a, c, t, g, unknown or other
  modified_base (468)..(468): a, c, t, g, unknown or other
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcgtcttccagggccactggcgtcccggccaggttcagtggcagtgggtctgggacagacttcactctcaccatcagcagcctagagcctgaagattttgctactttattactgtcaccagcgtagcagctggcctcgaacgttcgcaggacgaggtggacancaagcgaacngtggctgcacactctgtcttctatcttcccgt

SEQ ID NO: 781690 - DNA, 513 bp, Homo sapiens
  misc_feature: HIJSMM301AP5QE.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggccctgtcctggtcatttatgaggacaagaaacgaccctccgggatccctgacagactctctggctccagctcaggacagtggccaccttgactatccactggggcccaggtggaggatggaaggagactactattgttactctccagagaaggatggtcatcattggtgttcgggcggagggaccaagctagaccgtcctaagtcacgccaaggctcgccccctcggtcactctcgttcccgcccttcccg

SEQ ID NO: 781691 - DNA, 497 bp, Homo sapiens
  misc_feature: HIJSMM301CJRBT.21.65.F10.1.454.light.4.raw
  modified_base (481)..(481): a, c, t, g, unknown or other
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtcggctcggacgtcgccgaacggaccgaaggtaggaatacgaaacgaacgtagtaggcgtgcncactactctcttctta

SEQ ID NO: 781692 - DNA, 512 bp, Homo sapiens
  misc_feature: HIJSMM301CAQTX.43.67.G01.1.454.light.4.raw
tgtgagtagtcacgaccggtgctcgatttagagtatacatattgggtttgggggacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagcctagagtgttttatatagccccaggaacaaggactacctggcttggttccagcacaaaccagggcagcctccaaagctgctcatttacttgggatctacccgggaatccggggtccctgaccgattccgtggcaggcgggtctgggacagacttcactctcaccatcagtagcctgcagcctgaagatgtggcaacttattactgtcaacaatttcgttatactccgccgacgttcggccggggaccgaccgtggaaatcaacgaactgtggctgcaccatctgtcttcattccc

SEQ ID NO: 781693 - DNA, 506 bp, Homo sapiens
  misc_feature: HIJSMM301EMNDR.43.34.D01.1.454.light.4.raw
tgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcgaggggtttctgatcgcttctctggctccaagtctggcaacacggcctccctgacaatctctgggcctcgagctgaggacgaggctgattattattgctgctcatatgcaggtagttcaacttatgttcttcggaattgggacgacggtcaccgtcctaggtcacgcccaacggcccaaccccc

SEQ ID NO: 781694 - DNA, 523 bp, Homo sapiens
  misc_feature: HIJSMM301AKO7T.16.1.A01.1.454.light.4.raw
tgtactactccacgaccggtgctcgatttagacgtctcatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggcaaagcccccaaactcatcatttatgaagtctctaagcggccctcagggtatctaatcgcttctctggctccaagtctggcaacacggcctccctgaccgtctctggcctccagactgaggacgaggctgtattattactcgccactcatatagaagtagtactactcctgttggttttcggcggagggaccaagacgtgaccgtcctaggtcacgacccgaaggcgtcgcccccttaccggcctactctcgtt

SEQ ID NO: 781695 - DNA, 492 bp, Homo sapiens
  misc_feature: HIJSMM301A3WKF.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcgaactgcgaccaagtcaccgtcctgggtcagcccaaggccaacccactgt

SEQ ID NO: 781696 - DNA, 496 bp, Homo sapiens; identical to SEQ ID NO: 572961
  misc_feature: HIJSMM301ARRAE.22.5.A05.1.454.light.4.raw

SEQ ID NO: 781697 - DNA, 507 bp, Homo sapiens
  misc_feature: HIJSMM301ANU12.9.81.H04.1.454.light.4.raw
  modified_base (496)..(496): a, c, t, g, unknown or other
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgatttattactgcagctcatatgcaggccacccacaatgtcttcggaagtgggaccacggtcaccgtcctaggtcagcccaaggcccaaccccnctcgtcacttc

SEQ ID NO: 781698 - DNA, 502 bp, Homo sapiens
  misc_feature: HIJSMM301C5KAO.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacacgccactctgaccatcagcgggacccaggctatggatgaggctgacttattactgtcaggcggtggacatcagcagtggtagggttgggttttcgggtcgggacgggaccgaaggctcggtacccggtcctaacgtctacggaacccc

SEQ ID NO: 781699 - DNA, 500 bp, Homo sapiens
  misc_feature: HIJSMM301AP57U.4.39.D06.1.454.light.4.raw
agcactgtagcacgaccggtgctcgatttagtgacatctcgcagttctttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgatttatattgcagctcatatgcaggcagttacaatgtgatattcggcggagggaccaaactgaccgtcctaggtcagcccaaggctgccccctcggtcactctgttcccgccctcctcctacagtgct

SEQ ID NO: 781700 - DNA, 502 bp, Homo sapiens
  misc_feature: HIJSMM301DD9V3.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatacaacaaaagcctggccaggctcccagactcctcatctctggtgcatcttcgagggccactggtgtcccagccaggttcagtggcaggtgggtctggaacagagttcactctcaccatcagcggcctgcagtctgaagtattttgctagtttattactgtcagcagtataatgtacttgggttttattctactttcggccctgggaccaaagtggtatttcagacgaactgtggctgacaccatctgttcttcta

SEQ ID NO: 781701 - DNA, 515 bp, Homo sapiens
  misc_feature: HIJSMM301EYZ30.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagcccaccctcggtgtccgggggcctgggacaggccgccacagtcacctgcaccgggaacaccaacaatgtcggcgaccagggagccgcttggctggcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcgttggtcttttcggcggagggaccaagctgaccgtcctgggtcacgcccaaggcctcgccccctcggtcctacc

SEQ ID NO: 781702 - DNA, 533 bp, Homo sapiens
  misc_feature: HIJSMM301CV75E.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagttttattactgtcaacagttttctcgggtcgttcgccgtaacggacccgaaggtcggtaaagtacgaaaccgaaacgtacgtggtaccgtggccaccaccgtacttcgtcttctactccttccccg

SEQ ID NO: 781703 - DNA, 487 bp, Homo sapiens
  misc_feature: HIJSMM301DE3VB.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgttcagcagtatggtcacgtccaagaactttggccaggggaccaagctggagatacaaacgaactagtggctgcaccat

SEQ ID NO: 781704 - DNA, 510 bp, Homo sapiens
  misc_feature: HIJSMM301BD8IR.15.59.F04.1.454.light.4.raw
  modified_base (499)..(499): a, c, t, g, unknown or other
tctacgtagccacgaccggtgctcgatttagtacacacacttagggattggggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgcctcaccatcacgggggcccaggcagatgatgaatctgttattattgtgtcctatatatgggtgctggctatttcggtcgtttcggcggagggaccaagctgaccgtctaaggtccagcccaggccngccccctcggt

SEQ ID NO: 781705 - DNA, 503 bp, Homo sapiens
  misc_feature: HIJSMM301DXJ4H.4.41.D08.1.454.light.4.raw
agcactgtagcacgaccggtgctcgatttagtcacgcgagaaagggaaagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgagttcagaggcagtggatctgggacagatttcactctcaccatcagcggcctgcagcctgaagattatgcaacttactattgtcagagtttctaattctttcccgcgtcacggttttggccgtaagggggaccaaagggttagaggattacaaacgaactagtggctgcaccatcttcg

SEQ ID NO: 781706 - DNA, 504 bp, Homo sapiens
  misc_feature: HIJSMM301BQP92.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgtttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctggaggatgaggctgattattattgcagctcatatgcaggcagttacaatgtgatattcggcggagggaccaaactgaccgtctaggtcagcccaaggctcgccccctc

SEQ ID NO: 781707 - DNA, 515 bp, Homo sapiens
  misc_feature: HIJSMM301C197Q.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggcttgactattactgcctactctactttgtggtgctgtgctatcggtcggagggacctaagctgaccgtcttaaacgtcagcccaaggctgccccctcggttcactctgtttccca

SEQ ID NO: 781708 - DNA, 500 bp, Homo sapiens
  misc_feature: HIJSMM301AOXPT.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccacggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactcgcgaccaaggtcaccgtcctggtcacgcccaacggcccaacccccactgt

SEQ ID NO: 781709 - DNA, 375 bp, Homo sapiens; identical to SEQ ID NO: 713817
  misc_feature: HIJSMM301EM4LI.40.9.A09.1.454.light.4.raw

SEQ ID NO: 781710 - DNA, 478 bp, Homo sapiens
  misc_feature: HIJSMM301BP2BZ.8.14.B03.1.454.light.4.raw
ctcgcgtgtccacgaccggtgctcgatttagtgtgagtagttccgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggagtcctccccactatctcctgaggtataaaacagactcagataaggagcaggcctctggagtccccagccgcttctctggatccaagatgctgcggccaatgcagggagtttgctcatctcttgggctccagtttgaggatgaggctgactattattgtatgatttggtacaggagcgcttgggtgagttcggcggagggaccaaggctgaccgtcctaggtc

SEQ ID NO: 781711 - DNA, 528 bp, Homo sapiens
  misc_feature: HIJSMM301AO5H0.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggcgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcattatacaaccagtgacacttgggtggttcggcgggagggaccaggctggaccgtcctaggtcagcccaaggctcgccccctcggtcactctcgttcccaccct

SEQ ID NO: 781712 - DNA, 484 bp, Homo sapiens
  misc_feature: HIJSMM301E342E.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggcccccagacaccggagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgatttattattgccagtcctatgacaacaccctgcgtggttttggctgttcggcggcgggacc

SEQ ID NO: 781713 - DNA, 502 bp, Homo sapiens
  misc_feature: HIJSMM301ERO0W.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaacggccaaccccac

SEQ ID NO: 781714 - DNA, 497 bp, Homo sapiens
  misc_feature: HIJSMM301BQDSV.51.6.A06.1.454.light.4.raw
cgatcgtatacacgaccggtgctcgatttagatctactgacagggggctgtgggtccaggaggcagaactctgggtgtctcaccatggcctggatccctctactcctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgacttatttctgtcaatcttcagacatcagtggtacttatgttcttcggaactgggaccaaggtcaccgtccgtaggtcacgcccaaggcccaaccccactcgtcta

SEQ ID NO: 781715 - DNA, 469 bp, Homo sapiens
  misc_feature: HIJSMM301EWMI0.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggacagattttaattcaccatcagcagcctccaacgtgatgatgttgcaacatactattgtcagcaatatgatttgctcctccgagtgcacttttggcggggggaccaaggtggacatacaaacgaa

SEQ ID NO: 781716 - DNA, 491 bp, Homo sapiens
  misc_feature: HIJSMM301DYHFD.13.67.G01.1.454.light.4.raw
  modified_base (426)..(426): a, c, t, g, unknown or other
tcacgtactacacgaccggtgctcgatttagagtatacatattgggtttggggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtgcagtttatactgtcngcaatattatagtactcctccgaggctcactttcggcggaggaccaaggtgagactcaacgaact

SEQ ID NO: 781717 - DNA, 486 bp, Homo sapiens
  misc_feature: HIJSMM301D97SR.47.60.F05.1.454.light.4.raw
  modified_base (436)..(436): a, c, t, g, unknown or other
  modified_base (461)..(461): a, c, t, g, unknown or other
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggtttcagtggcagtgcgtctgcgacagagttcactctcaccatcaacagcctgcagtctgaagattttagctagtttattactgtcagcagtatcatgactggccgctcnccttcggccaaggacacgactgganagttaaacgaactgtggctgcacat

SEQ ID NO: 781718 - DNA, 485 bp, Homo sapiens
  misc_feature: HIJSMM301BR9FM.43.24.C02.1.454.light.4.raw
  modified_base (398)..(398): a, c, t, g, unknown or other
tgtgagtagtcacgaccggtgctcgatttagtacagatcgttagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggcngaggatggttggggtttattactgcatgcaagctctacaaactccgctcactttcggcggagggaccgaaggtggagatcaaacgaa

SEQ ID NO: 781719 - DNA, 508 bp, Homo sapiens
  misc_feature: HIJSMM301E1XA8.4.10.A10.1.454.light.4.raw
agcactgtagcacgaccggtgctcgatttagcgtcgatctcaggggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagccaaggctgccccctcggtcactctgttcccta

SEQ ID NO: 781720 - DNA, 500 bp, Homo sapiens
  misc_feature: HIJSMM301DAFQN.43.25.C03.1.454.light.4.raw
tgtgagtagtcacgaccggtgctcgatttagtagtgtagatttgggtttgggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgagatgttggggtttattactgcatgcaaggtacacactggcccgtcaccttcggccaacgggacacgactggagtattaaacgaactgtgctcgcaccatt

SEQ ID NO: 781721 - DNA, 500 bp, Homo sapiens
  misc_feature: HIJSMM301B6A6W.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccgaggctgaggacgaggctgattattactgcagctacatatacaagcagcagcactctcgtggtattcggcggagggaccaagctgaccgtccaggtcagcccaaggctccg

SEQ ID NO: 781722 - DNA, 488 bp, Homo sapiens
  misc_feature: HIJSMM301DY93F.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagttttattacttgtcagcagtattgtggaagctccgctcacttttcggcggagggaccggcggtggagatcaagctaaactgtggctgcaccatcctagtcctt

SEQ ID NO: 781723 - DNA, 459 bp, Homo sapiens
  misc_feature: HIJSMM301BWYF3.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgatagtgtgaacggtccggttttcggcggagggaccaagctgaccgtcctaagtcagcgcgaaggctcgccccctcggtccactctcgttcccgccctcctccacgagagta

SEQ ID NO: 781724 - DNA, 530 bp, Homo sapiens
  misc_feature: HIJSMM301CBNT0.27.23.C01.1.454.light.4.raw
  modified_base (514)..(514): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacgttgggtgttcgggcgggagggaccgaggctggaccgttccgtaggtcagcccaaggctcgccccctcggtcnctctcgttcccaccct

SEQ ID NO: 781725 - DNA, 493 bp, Homo sapiens
  misc_feature: HIJSMM301EL054.16.86.H09.1.454.light.4.raw
tgtactactccacgaccggtgctcgatttagtgctatagacttgggtttggggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattatgcatctcatatacaaccaacagcactctcgactggtattcggcggagggacccaagctgacccgtcctaggtctagcccaaggcctgcccccctcggtcacttcctcgttccccaccctccttccgagtacgtaacca

SEQ ID NO: 781726 - DNA, 508 bp, Homo sapiens
  misc_feature: HIJSMM301DHG98.52.87.H10.1.454.light.4.raw
cgcagtacgacacgaccggtgctcgatttagcagtactgcgttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtaagtggtacttatgtgcagttcggcggagggaccaagctgaccgtcctagggtcagacccaagggctcgcccccctcggtcctaccg

SEQ ID NO: 781727 - DNA, 484 bp, Homo sapiens
  misc_feature: HIJSMM301BPQRW.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtcctgaccgattccgtggcagtggatctgggacaaatttcactctcaccatcaatagcctgcaggctgaagatgtggcagcttattattgtcagcaatattattacttcttcttccgatctacttttggcctaggggaccaggctggagatcagacgaactgt

SEQ ID NO: 781728 - DNA, 489 bp, Homo sapiens
  misc_feature: HIJSMM301C42DG.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaaccgtccgtaggtcacg

SEQ ID NO: 781729 - DNA, 518 bp, Homo sapiens
  misc_feature: HIJSMM301BQW1U.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatcggccaccttgactatcagtggggcccaagtggaggatgaagctgactactactgttactacaatagagaacagtgataatttctgggtagttcgggcggagggaccaaactgaccgtcctaggtcagcccaaggctcgccccctcggtcacctctcgttcccccg

SEQ ID NO: 781730 - DNA, 491 bp, Homo sapiens
  misc_feature: HIJSMM301CYX9F.26.45.E01.1.454.light.4.raw
  modified_base (400)..(400): a, c, t, g, unknown or other
  modified_base (451)..(451): a, c, t, g, unknown or other
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactagaaaatcaagtagagtggaggcngaggatgttggagttttattactgcatgcaagctctaacaaactcctctcnctttcggcggagggaccgagggtgggacgatcagacggaa

SEQ ID NO: 781731 - DNA, 474 bp, Homo sapiens
  misc_feature: HIJSMM301CIJEX.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgagctgactattactgtcaggcgtgggacatcagcagtgaggtggtttcgggcggagggacagctgaccgtctaagtcacgccac

SEQ ID NO: 781732 - DNA, 504 bp, Homo sapiens
  misc_feature: HIJSMM301DVFBN.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctctatttactgggcgtcgtacccgggaatccggggtccctgaccgattcagtggcagcgggtctgggacagatttcactctcaccatcagcagcctgcaggttgaagatgtggcagtttattactgtcagcagtattatactactcctactgtacgttcggccgaagggaccgaaaggtggagatcaaaacgaactgtcggctgcacccat

SEQ ID NO: 781733 - DNA, 489 bp, Homo sapiens
  misc_feature: HIJSMM301DEB7Q.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactctcgttcccgccctcctcgctacgtaga

SEQ ID NO: 781734 - DNA, 467 bp, Homo sapiens
  misc_feature: HIJSMM301CW6B6.26.78.H01.1.454.light.4.raw
  modified_base (461)..(461): a, c, t, g, unknown or other
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctctactttcggcgggagggaccgagggtggagatcagacgaactgtggctgcaccatctgtcttcatcttcccgcatctgaagtntagtct

SEQ ID NO: 781735 - DNA, 511 bp, Homo sapiens
  misc_feature: HIJSMM301C2A4H.43.67.G01.1.454.light.4.raw
tgtgagtagtcacgaccggtgctcgatttagagtatacatattgggtttgggcggtgctcgatttagagtatacatattgggtttggggggctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcacaatttcgttatactccgccgacgttcggccgggggaccgaccgtacgg

SEQ ID NO: 781736 - DNA, 501 bp, Homo sapiens
  misc_feature: HIJSMM301B7J1G.48.23.C01.1.454.light.4.raw
agtatacatacacgaccggtgctcgatttagtacacgtgattagggattgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggaccacgactggagattaaccgaactgtggctgcaccatctgtcttcatt

SEQ ID NO: 781737 - DNA, 496 bp, Homo sapiens
  misc_feature: HIJSMM301A1OJ6.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttggccaagggaccaaggtggaaatcaaacgaactgtggctgcacca

SEQ ID NO: 781738 - DNA, 539 bp, Homo sapiens
  misc_feature: HIJSMM301AFAR9.18.59.F04.1.454.light.4.raw
  modified_base (438)..(438): a, c, t, g, unknown or other
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacgncgactcctctaagttcgttacgtacggtaacggtacggaccgtaacggtcctacccgttacgtcggtacaccggacccgaaccggacccccaaccctaccg

SEQ ID NO: 781739 - DNA, 499 bp, Homo sapiens
  misc_feature: HIJSMM301AIVKE.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagtatttctaatcgggagttccggggtcccagacagattcagcggcaggtgggtcaggcactgatttcacgctgaagatcagcagggtggaggctgaggatgttgtcggtttattactgcctgcagagtattcacgtggccgtggacgttcggcgaacgggacaacggtaggaatacaaacgaactagtgg

SEQ ID NO: 781740 - DNA, 479 bp, Homo sapiens; identical to SEQ ID NO: 558912
  misc_feature: HIJSMM301EFK89.40.23.C01.1.454.light.4.raw

SEQ ID NO: 781741 - DNA, 498 bp, Homo sapiens
  misc_feature: HIJSMM301DVH9O.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggcctgaggatgaggctgattattactgcagctcatatgcaggcagcagcagtccccatgtgatcttcggcggggggaccaaggctgaccgtcctaggtcagccc

SEQ ID NO: 781742 - DNA, 476 bp, Homo sapiens
  misc_feature: HIJSMM301AKYO7.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagtatttcactctcaccatcagcagtctgcaacctgaagattttgcaacttactactgtcaacagagttacagtaccccgtggacgttcggccaaggaccaaggtaggaaatacaaacgaactgtggct

SEQ ID NO: 781743 - DNA, 503 bp, Homo sapiens
  misc_feature: HIJSMM301APVLH.41.34.D01.1.454.light.4.raw
tctatactatcacgaccggtgctcgatttagatcgtctgtgttgggtttgggggctttgcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcacgcccaaggcctgccccctcggtcactctcgttcccaccctcctcatagtat

SEQ ID NO: 781744 - DNA, 494 bp, Homo sapiens
  misc_feature: HIJSMM301EBHDO.3.33.C11.1.454.light.4.raw
agacgcactccacgaccggtgctcgatttagagtgagctcgttgggtttggggctttgcctggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggaggaccaagctgaccgtcctaggtcagcccaagctgccccctcggtcactctgttcccaaccctcctcgagtgcgtcct

SEQ ID NO: 781745 - DNA, 505 bp, Homo sapiens; identical to SEQ ID NO: 535503
  misc_feature: HIJSMM301AVPYK.8.28.C06.1.454.light.4.raw

SEQ ID NO: 781746 - DNA, 494 bp, Homo sapiens
  misc_feature: HIJSMM301ECL9O.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaagtcaccgtcctgggtcagcccaaggcccaaccccactgtca

SEQ ID NO: 781747 - DNA, 542 bp, Homo sapiens
  misc_feature: HIJSMM301EF42Y.9.2.A02.1.454.light.4.raw
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggccctccctgaccatctctggacttcagcctgaggacggagggtgattacttcctgcagttcagattcaagaaactttccccctcggtttgggtcggtttcgggcgggacggggaccatgcctgacccgtcctgacgtcagcccaaggcctcgccccctcggtcactctcgttcccgccccttcc

SEQ ID NO: 781748 - DNA, 485 bp, Homo sapiens
  misc_feature: HIJSMM301B261N.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcagtcccaagaactttggccaggggaccaagctggagatcaaacgaactgtggctggcaccat

SEQ ID NO: 781749 - DNA, 354 bp, Homo sapiens
  misc_feature: HIJSMM301ARJK3.19.22.B11.1.454.light.4.raw
tactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactccaataataagaactacttagcttggttccagcagaaaccaggacagccctcctaagatgctcttttattggcatctgcccgggaatccggggtccctgaccgattcagtggcagcgggtctgggacagatttcactctcacca

SEQ ID NO: 781750 - DNA, 504 bp, Homo sapiens
  misc_feature: HIJSMM301B11CI.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaacgcccctacactcctgatcaatgcagcgtccagtttacagagtggggtcccctcaaggttcagtggcagtggatctgggacagactttactctcaccatcagcgatctgcagcctgacgattttgcgtacttactactgtcaacagagtttccggaacccgttactttcggcggtagggaccgaaggtggacgatcaaacgaacctgtgctgcaccatctcgtcttcatcttccccg

SEQ ID NO: 781751 - DNA, 490 bp, Homo sapiens
  misc_feature: HIJSMM301A9V9U.47.60.F05.1.454.light.4.raw
  modified_base (340)..(340): a, c, t, g, unknown or other
  modified_base (464)..(464): a, c, t, g, unknown or other
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtncgtctgcgacagagttcactctcaccatcaacagcctgcagtctgaagtattttgctagttttattactgtcagcagtatcatgactcggccgctccaccttcggccaagggacacgactgganaattaaacgaactgtggctgcaccat

SEQ ID NO: 781752 - DNA, 467 bp, Homo sapiens
  misc_feature: HIJSMM301D4SPC.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgatttattactgcagctcatatacaagcaccagcactctctatgtcttcggaactgggaccaaggtcaccgtcctaggtcagcccaaggcccaacccactgtcactctcgttccccaccctcctccatactcgta

SEQ ID NO: 781753 - DNA, 493 bp, Homo sapiens; identical to SEQ ID NO: 741962
  misc_feature: HIJSMM301ETWID.11.25.C03.1.454.light.4.raw

SEQ ID NO: 781754 - DNA, 485 bp, Homo sapiens
  misc_feature: HIJSMM301A73T6.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctatttactgtcagcagtatggtcacgtccaagacttttggccaggggaccaagctggagatcaaacgaactgtggctgcaccat

SEQ ID NO: 781755 - DNA, 519 bp, Homo sapiens
  misc_feature: HIJSMM301CI127.13.39.D06.1.454.light.4.raw
  modified_base (473)..(473): a, c, t, g, unknown or other
  modified_base (503)..(503): a, c, t, g, unknown or other
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccgacaataggaactacttagcttggtaccaacagaaaccaggacagcctccgaagttactcttttactgggcgtctacccgggaatccggggtccctcgaccgattcagtggcagcgggtctgggacagatttcactctcaccatcagcagccttcaggctgaagatgtggcagtttattacttgtcagcaatattatattctctcctcctcgacgtgtccgacgacgacggnggaaggtacaaacgaacaacgtagtcggtncgtaccactacctgtt

SEQ ID NO: 781756 - DNA, 383 bp, Homo sapiens; identical to SEQ ID NO: 447524
  misc_feature: HIJSMM301DZ122.41.26.C04.1.454.light.4.raw

SEQ ID NO: 781757 - DNA, 489 bp, Homo sapiens
  misc_feature: HIJSMM301DUMTY.26.45.E01.1.454.light.4.raw
  modified_base (431)..(431): a, c, t, g, unknown or other
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcaccccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggtagtttattactgcatgcaanctctacaaactcctactcactttcggcggagggaccgaaggtggagatacaaacgaac

SEQ ID NO: 781758 - DNA, 499 bp, Homo sapiens
  misc_feature: HIJSMM301ANGXM.3.72.G06.1.454.light.4.raw
agacgcactccacgaccggtgctcgatttagctacgactgcaagggaaaggggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctggaagtattttgctagttttattactgtcagcaggcgtagcaactggcctctcaccgttcggcggagggaccaaggtggagatacaaacgaactgtggctgcaccatctgtt

SEQ ID NO: 781759 - DNA, 494 bp, Homo sapiens
  misc_feature: HIJSMM301AIHCG.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaccagcgtagcagctggcctcgaacgttcggccaagggaccgaaggtaggacatacaacgcgaacctggtcggct

SEQ ID NO: 781760 - DNA, 488 bp, Homo sapiens
  misc_feature: HIJSMM301CLYDA.46.35.D02.1.454.light.4.raw
  modified_base (408)..(408): a, c, t, g, unknown or other
  modified_base (460)..(460): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattacngtcagcagtatggtcacgtcccaagaacttttggccagggaccgaagctggngatcaaacgaactcgtggctgcaccata

SEQ ID NO: 781761 - DNA, 488 bp, Homo sapiens
  misc_feature: HIJSMM301ALHPQ.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaattttatactgtcagcaatataatacctggcctccgctcacgtttcggcggagggaccaaggttgagatcaaacgaactgtggctgcacc

SEQ ID NO: 781762 - DNA, 501 bp, Homo sapiens
  misc_feature: HIJSMM301EPC5T.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggctccctgaccgtctctgggctccaagctgaggatgaggctgattattactgcagctcatatgcaggcagcagcaatgtacttttcggcggagggaccaagctgacgtcctggtcagcccaaggctgccccctcggtcac

SEQ ID NO: 781763 - DNA, 521 bp, Homo sapiens
  misc_feature: HIJSMM301BE036.5.27.C05.1.454.light.4.raw
atcagacacgcacgaccggtgctcgatttagacgcgatcgaagggtttgggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggactggaccaaggtcaccgtcctaggtcagcccaaggcccaacccactgtcactctcgttcccgccctcctccgtt

SEQ ID NO: 781764 - DNA, 493 bp, Homo sapiens
  misc_feature: HIJSMM301CZCCZ.41.53.E09.1.454.light.4.raw
tctatactatcacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctcaagtctggcaacacggcctcctgaccatctctgggctccaggctgaggacgaggctgattattactgcagctcatatacaagcagcagcactctcgtggtattcggcgaggccaagctgacgtcctaggtcagcccaagctccg

SEQ ID NO: 781765 - DNA, 551 bp, Homo sapiens
  misc_feature: HIJSMM301C917B.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctccccaggcccctcatctatggtgcatccaacagggccactggcatcccagccaggttcagtggcagtgggtctgggacagacttcactctcaccatcatcagcctggagcctgaagatgttgctagtttattactgtcaacatcgtaccgagtcggccgtccgggggccctacgttttccggcccgttacggggaacctaaacggtagggtattacgttaccaaaaccggtaacttaggtaggtccttggcctacccacttcgtcgttt

SEQ ID NO: 781766 - DNA, 516 bp, Homo sapiens
  misc_feature: HIJSMM301A3Y8H.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcgaggcggaagatggaggctgactattactgtaacctcccgggacagcagtgctgaccgaggtggtagttcgggcgggacgggacccacctcgacccgtcttaggtcacgcccaaggctcgccccctcggtctacc

SEQ ID NO: 781767 - DNA, 504 bp, Homo sapiens
  misc_feature: HIJSMM301CPGQM.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggcgaggctgattattactgcagctcatatacaagcaccagcactctctatgtcttcggaactgggaccaaggtcaccgtcctaggtcagcccaaggcccaaccccta

SEQ ID NO: 781768 - DNA, 423 bp, Homo sapiens
  misc_feature: HIJSMM301DFOU5.41.82.H05.1.454.light.4.raw
tctatactatcacgaccggtgctcgatttagtcgagctctctcgcgggcacgaccggtgctcgatttagtacgctgtctttggggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatccttcccgccatctgaatagtataga

SEQ ID NO: 781769 - DNA, 513 bp, Homo sapiens
  misc_feature: HIJSMM301EUMWT.2.71.G05.1.454.light.4.raw
  modified_base (495)..(495): a, c, t, g, unknown or other
acgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgagctgactattattgtaagtccgggacagaagtgggtaattacattggtggttcggacggagggaccaagctgacccgtcctaacgtcacgcccaaggcncgccccctcggtcacgtt

SEQ ID NO: 781770 - DNA, 493 bp, Homo sapiens
  misc_feature: HIJSMM301ALZ1R.51.59.F04.1.454.light.4.raw
cgatcgtatacacgaccggtgctcgatttagtacacacacttagggattggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcaggaggacgaggctgactattattgtcaatcaacagacaccattggtacttatgtcttcggaactgcgaccaaggtcaccgtctggtcagccaggccaacccactgtcact

SEQ ID NO: 781771 - DNA, 364 bp, Homo sapiens
  misc_feature: HIJSMM301DUIGD.41.34.D01.1.454.light.4.raw
tctatactatcacgaccggtgctcgatttagatcgtctgtgttggggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaacgcccctaaattcctgatctatcaggcatctaatttggaaagtggggtccatcaaggtttagcggcagtggatcgtgggacagaattcactctcacga

SEQ ID NO: 781772 - DNA, 483 bp, Homo sapiens
  misc_feature: HIJSMM301DNG4R.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatatcggttcagtgggcggtggatctaggacagaattcactctcaccatccaccaacctgcaccctgaagatgttggaagttattactgtcagacctatagtggtggcccgctctattttcggcggagggaccgaaggtgcagatacaacgaactgtgg

SEQ ID NO: 781773 - DNA, 505 bp, Homo sapiens
  misc_feature: HIJSMM301DW0NY.47.83.H06.1.454.light.4.raw
  modified_base (406)..(406): a, c, t, g, unknown or other
  modified_base (462)..(462): a, c, t, g, unknown or other
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaagctgccctcaccntcggcggggcccaggcagatgatgagtgtgattattactgtgtgctctatatggcnggtggcgtttgggtgttcggcggagggaccaagctgaccgtcg

SEQ ID NO: 781774 - DNA, 459 bp, Homo sapiens
  misc_feature: HIJSMM301BNEIQ.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgacgtcctaggtcagcccaaggctgctccctcggtcactctgttcccgccctcctcacgcgtatgt

SEQ ID NO: 781775 - DNA, 549 bp, Homo sapiens
  misc_feature: HIJSMM301C2V0L.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggccgcctaatttataagatttctaatcgggattcccggggtcccagacacgattcagcggcaggtgggtcaggcactgatttcacgctgaagatcagcaggggtgaggctggagatgttgcggtttattactgcctgcagagttattccactgggcccggttgggaccggttccggacccggaagggacccgaaaggggtaggtaaaactaccaaaacggaactcggttcgggctcggaccaacccgtattaccg

SEQ ID NO: 781776 - DNA, 503 bp, Homo sapiens
  misc_feature: HIJSMM301B0K5K.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactggaccaaggtcaccgtctagtcagcccaaggcccaacccactgtcta

SEQ ID NO: 781777 - DNA, 509 bp, Homo sapiens
  misc_feature: HIJSMM301AGUEA.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactaggaatcagcaggggtggaggctgaggattggttggggtttattactgcatgcaaactacacacggccgctcactttcggcggagggacgaaggtggagatcaaacgaactgtggctgcaccatctgtt

SEQ ID NO: 781778 - DNA, 489 bp, Homo sapiens
  misc_feature: HIJSMM301AD2CS.16.86.H09.1.454.light.4.raw
tgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcgggcggaggggaccaagctgaccgtcctaggtcagcccaaggctcgccccctcggtcactctgtttcccccaccttccctcgagttaggtacca

SEQ ID NO: 781779 - DNA, 499 bp, Homo sapiens
  misc_feature: HIJSMM301CNQ6Y.51.81.H04.1.454.light.4.raw
  modified_base (390)..(390): a, c, t, g, unknown or other
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggcngacttattattgcaatcaaacagacaccattggtacttatgtcttacggaactgcgaccaaggtcaccgtcctgggtcagcccaaggccaccccatgtccactcttccg

SEQ ID NO: 781780 - DNA, 517 bp, Homo sapiens
  misc_feature: HIJSMM301AG3HM.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgttggttttcggcggtaggcaccgaaggtgaccgtcctcggtcagcccaaggctgccccctcggtcactc

SEQ ID NO: 781781 - DNA, 502 bp, Homo sapiens
  misc_feature: HIJSMM301A098K.5.23.C01.1.454.light.4.raw
atcagacacgcacgaccggtgctcgatttagtacacgtgattagggattggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctagggacagatttcactctcaccatcagtagtctacaacctgaagtattttgcaacttactactgtcaacagagttacgactacccctccgctcactttcggcggagggaccaaggtggagatacgtaaacgaacctgtcggctggcaccattcctgttctta

SEQ ID NO: 781782 - DNA, 494 bp, Homo sapiens
  misc_feature: HIJSMM301BFUJI.46.35.D02.1.454.light.4.raw
  modified_base (467)..(467): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagacttcagtggcagtggggtctgggacagacttcactctcaccatcagcagactggagcctgaagattttgcagttctatttactgttcagcagtatggtcacgtcccaagaacttttggccaggggaccaagctagganatacaaacgaactgtggctgacaccat

SEQ ID NO: 781783 - DNA, 510 bp, Homo sapiens
  misc_feature: HIJSMM301DXV44.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtcttattactgtcagacaattataattactggtctcttcgtttcgggcgggggaccaagcgtggagtatacaaccgtaactggtcggctcggccacactctgtt

SEQ ID NO: 781784 - DNA, 501 bp, Homo sapiens
  misc_feature: HIJSMM301B0Y0M.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcgggggaccaagctgaccgtcctaggtcagcccaaggctcgccccctcggtcactctccg

SEQ ID NO: 781785 - DNA, 502 bp, Homo sapiens
  misc_feature: HIJSMM301CB8YS.48.28.C06.1.454.light.4.raw
agtatacatacacgaccggtgctcgatttagagctcacgtattgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctgctccaagtctggcaacacggcctccctgaccgtctctgggctccaggctgaggatgaggctgattattactgcagctcatatgcaggcagctaacaatgtggtattcggcggagggaccaagctgaccgtcctaggtcagccaaggctcgcccctcc

SEQ ID NO: 781786 - DNA, 490 bp, Homo sapiens
  misc_feature: HIJSMM301AD770.40.82.H05.1.454.light.4.raw
tctagcgactcacgaccggtgctcgatttagtcgagctctctcgcgggcacgaccggtgctcgatttagtagtgtagattcgcggggtgactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagtattttaacactgaaaatcagcaggggtggaggcaggaagatggttgggattttattactgcatgacaacctctacaactagtgt

SEQ ID NO: 781787 - DNA, 486 bp, Homo sapiens
  misc_feature: HIJSMM301A2ZMA.48.78.H01.1.454.light.4.raw
agtatacatacacgaccggtgctcgatttagtgtgagtagtttgggtttggggtgggggagcctagctgtgctgtgggtccaggaggcagaactctgggtgtctcaccatggcctggatccctctacttcctccccctcctcattctctgcacaggctctgaggcctcctatgaactgacacagcccaccctcggtgtcagtgtcccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagcgaggctgactactattgtcagtcaaggagaacaatactacgcacgcaagtactgttcggcggagggaccaagctgac

SEQ ID NO: 781788 - DNA, 460 bp, Homo sapiens; identical to SEQ ID NO: 536053
  misc_feature: HIJSMM301CDT1B.22.28.C06.1.454.light.4.raw

SEQ ID NO: 781789 - DNA, 494 bp, Homo sapiens; identical to SEQ ID NO: 647701
  misc_feature: HIJSMM301CGOGW.3.31.C09.1.454.light.4.raw

SEQ ID NO: 781790 - DNA, 528 bp, Homo sapiens
  misc_feature: HIJSMM301AXQBL.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccggacagactccacgcacgctcatctacaacacagacactcgctcttctggggtccctgatcgcttctctggttccatccttgggaacaaagctgccctcaccatcgcggggcccaggcagatgatgagtgtgtattattactgtgtcgcttctattattgggctaggtgggtcggttttggggttggttcgggcggaggggaaccaaggcctggaccgtttaccg

SEQ ID NO: 781791 - DNA, 486 bp, Homo sapiens; identical to SEQ ID NO: 546671
  misc_feature: HIJSMM301AUPNG.26.78.H01.1.454.light.4.raw

SEQ ID NO: 781792 - DNA, 499 bp, Homo sapiens
  misc_feature: HIJSMM301AET98.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggatttttgcagtgtattactgtcagcagtatcataggtcaaacaccttcggccaaggacacgactcggagattaaaggaaactgtaggctgcaccatactgtcttctatcttccccg

SEQ ID NO: 781793 - DNA, 489 bp, Homo sapiens
  misc_feature: HIJSMM301AK4HO.4.74.G08.1.454.light.4.raw
  modified_base (416)..(416): a, c, t, g, unknown or other
agcactgtagcacgaccggtgctcgatttagtagctctatcaggggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaagccccctaagctcctgatctacgctgcgtctagtttacagagtggagtcccatcaaggttcagcggcagtgatctggcacagatttcactctcaccatcagcagcctgcagcctgaggtattttgctaacttattactgtctacaanattacacttacccgtgggaccgttcggaccgaacgggaaccgaagggtaggaaagtacaaaaccggaactagt

SEQ ID NO: 781794 - DNA, 368 bp, Homo sapiens
  misc_feature: HIJSMM301AT6W8.41.34.D01.1.454.light.4.raw
tctatactatcacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccaagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacga

SEQ ID NO: 781795 - DNA, 497 bp, Homo sapiens
  misc_feature: HIJSMM301AWNCX.13.34.D01.1.454.light.4.raw
  modified_base (311)..(311): a, c, t, g, unknown or other
tcacgtactacacgaccggtgctcgatttagatcgtctgtgttgggtttggggagagctctgggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctccccaggctcctcatttatggtgnatccactagggccactggtgtcccagtcaggttcagcggcagtgggtctgggacagacttcactctcaccatcagcagcctgcagtctgaagtatttgcagtctattactgtcagcagtattagttactggacgtaaccttcggaccgaagggaacacggactggagaagttaaaggaactggtgg

SEQ ID NO: 781796 - DNA, 490 bp, Homo sapiens
  misc_feature: HIJSMM301AN1VK.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactattattgtcaggcgtgggacaggcagcactgcccgttatgtcttcggactgggaccaaggtcaccgtcttgagtcacgcccaaggccaaa

SEQ ID NO: 781797 - DNA, 499 bp, Homo sapiens
  misc_feature: HIJSMM301AR8EL.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagcccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttagcagtgtattactgtcagcagtatcataggtcaaacaccttcggccgaagggacacgactggagattaaaggaactagtggctgcaccatctgtcttcatccttccccg

SEQ ID NO: 781798 - DNA, 504 bp, Homo sapiens
  misc_feature: HIJSMM301CL8CE.18.59.F04.1.454.light.4.raw
  modified_base (386)..(386): a, c, t, g, unknown or other
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggntccaggctgaggacaggctgattattactgcagctccatatacaagcaccaagcactctctatgtcttcggaactgggaccaaggtcaccgtcctaaggtcagcccaaggccaaccca

SEQ ID NO: 781799 - DNA, 505 bp, Homo sapiens
  misc_feature: HIJSMM301EYNRP.5.86.H09.1.454.light.4.raw
atcagacacgcacgaccggtgctcgatttagtgctatagacttggggtttggggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgctaggcagccgtatactcttcggcggaggaccaagctgaccgtccgtaggtcagcccaaggctagccccctc

SEQ ID NO: 781800 - DNA, 511 bp, Homo sapiens
  misc_feature: HIJSMM301BZ27J.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaacgcccccaaactcatcatttttgaggtcactacgcgaccctcaggggtccctgatcgcttctctggctccaagtctggcaacacggcctccctgaccgtctctgggctccaggctgaggatgaggctgattattacttgcagctcataatgcgaggcagcagcacgtccccactgtgatcttcggtccggggggaccgaacgctgaccgtacctacggtcgacgcccg

SEQ ID NO: 781801 - DNA, 520 bp, Homo sapiens
  misc_feature: HIJSMM301C4VX0.14.70.G04.1.454.light.4.raw
  modified_base (506)..(506): a, c, t, g, unknown or other
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccatggttgcacgcaaagcggggacccagaccctggagcctcagttggaacgcagccgatccagcctgcggagcctgtgggcaggtcagcccgaaggccaaaccccnctcgtcactcttcg

SEQ ID NO: 781802 - DNA, 527 bp, Homo sapiens
  misc_feature: HIJSMM301APVT4.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcattttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtccgtaggtccagcccgaaggcctcggccccccgttcggtcaccttctcgttcccccta

SEQ ID NO: 781803 - DNA, 505 bp, Homo sapiens
  misc_feature: HIJSMM301EKPZ1.48.71.G05.1.454.light.4.raw
agtatacatacacgaccggtgctcgatttagtgtcgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgctagtgtttttctgtcagcagtatggaagttcacctcggacattcggccgaggggaccaaggtggaaatcaaacgaactgtggctgcacatctgtcttcatcttcccg

SEQ ID NO: 781804 - DNA, 494 bp, Homo sapiens
  misc_feature: HIJSMM301EK9TA.9.19.B08.1.454.light.4.raw
tgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagccccagggtcctcatctttggttacagtaatcggccctcacggggtccctgaccgattctctggctccaagtctgacacctcagcctccctggccatcactgggctccagactgaggatgaggctcattattactgccagtcttatgacaaacgtcagaacatttgggtgttcggcggagggaccaagctgaccgtcctctacg

SEQ ID NO: 781805 - DNA, 382 bp, Homo sapiens; identical to SEQ ID NO: 732798
  misc_feature: HIJSMM301C5T4D.41.27.C05.1.454.light.4.raw

SEQ ID NO: 781806 - DNA, 482 bp, Homo sapiens
  misc_feature: HIJSMM301EIJS3.51.60.F05.1.454.light.4.raw
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctcgtgggaacacagccactctgaccatcagcgggacgcaggctgtggatgaggctgacttttactgtcaggcgtgggacagcgacactgccgtgtcggcggagggaccaagctgaccgtcctcggtccagcccaaggctccc

SEQ ID NO: 781807 - DNA, 476 bp, Homo sapiens
  misc_feature: HIJSMM301C4ZNK.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtacggccgggcacctttggccaggggacgaagctggagatcgaacgaactgtggctgcaccatctgtcttcatccttcccgccatcgtgagacacgcggag

SEQ ID NO: 781808 - DNA, 501 bp, Homo sapiens
  misc_feature: HIJSMM301BDZDQ.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcaggtggcagtgggtctggggacagacttcactctcaccatcagcagactggagtctgaagtattttgcagtgtattattgtcagcaatatggtaggtcacctgggtacttttggccgaggggaccaagcgtggagatacaaacgaactgtggctgcaccatctgtctt

SEQ ID NO: 781809 - DNA, 493 bp, Homo sapiens
  misc_feature: HIJSMM301EIFP3.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgccgcatccaccagggccactggtatcccagccaggttcagtggcagtgggtctgggacagagttcactctcaccatcagcagcctgcagtctgaagattgtgcaatttattactgttcagcaatataataccgtggccctccgctccacgtttcggcgggagggaccaaggttgagatcaaacgaactgtggctgcacc

SEQ ID NO: 781810 - DNA, 493 bp, Homo sapiens
  misc_feature: HIJSMM301BLKQP.48.37.D04.1.454.light.4.raw
agtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactacgtgcagtggttccagcagcgcccgggcagttcgcccatcactgtgatctatgagaataatgagagaccctctggggtcccccgatcggttctctggctccatcgacaggtcctccaactctgcctctctcaccatctctggactgcagactgaggacgaggctgattactctgtcagtcttatgatagtggcaattaatgtttgggtggtttggcggagggaccaagctgaccgtcctaggtcacg

SEQ ID NO: 781811 - DNA, 503 bp, Homo sapiens
  misc_feature: HIJSMM301DD45K.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggacgggaccaggggtggagatacgaaacgaactgtggctgccaccatctgtcttcacttccg

SEQ ID NO: 781812 - DNA, 492 bp, Homo sapiens
  misc_feature: HIJSMM301EOTG4.26.45.E01.1.454.light.4.raw
  modified_base (403)..(403): a, c, t, g, unknown or other
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggntagttggagtttattactgcatgcaagctctacaaactcctctctactttcggcggagggaccgaaggtggagataccaaagaactagt

SEQ ID NO: 781813 - DNA, 514 bp, Homo sapiens
  misc_feature: HIJSMM301D5Z97.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggcgaggctgattattattggctgctcatattgcagggtagttacactttatgttcttcggtaaatttggggaacgacgggttcaccggttcctaggtcagcccaaggcccaacccct

SEQ ID NO: 781814 - DNA, 518 bp, Homo sapiens
  misc_feature: HIJSMM301AE6WP.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgatttattactgtcagctcatatgccagttcggttccttctttccaagatagttcggcggagggaccaggctgaccgtcctgacgtcacgcccaaggcctcgtcccccccg

SEQ ID NO: 781815 - DNA, 487 bp, Homo sapiens
  misc_feature: HIJSMM301ESF6N.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgtatttgctaacttattactgtcaacagtataatataattcctggtacgtcgccgaaggaccaaggtggaaatacaaacgaactgtggctgcacatctgtctt

SEQ ID NO: 781816 - DNA, 494 bp, Homo sapiens; identical to SEQ ID NO: 666540
  misc_feature: HIJSMM301B6I0E.43.29.C07.1.454.light.4.raw

SEQ ID NO: 781817 - DNA, 525 bp, Homo sapiens
  misc_feature: HIJSMM301CWL0D.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaacctggccaggctccccgactcctcttctttggtggagcctacagggccactggcaccccagacaggatcagtggcagcgggtctgggacagacttcattctcaccatcaacagactgcagcctgaagatattgctagtttactactgtcagcagtatgttacgtccccgtggaccgttcggccgaacgggaccgaaggtggcgaatcaaccgaactggtggctgcaccatctgtcttcatcttccccg

SEQ ID NO: 781818 - DNA, 504 bp, Homo sapiens
  misc_feature: HIJSMM301A3923.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggactgggaccaaggtcaccgtcctaggtcacgcccaaggcccaaccca

SEQ ID NO: 781819 - DNA, 486 bp, Homo sapiens
  misc_feature: HIJSMM301BYB51.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgcccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgctaacttactaactgtacaacagagtttcactacccctctcacgttcggcgggggaccgaaggtggagatcaaacgaactgtgctgcacta

SEQ ID NO: 781820 - DNA, 496 bp, Homo sapiens
  misc_feature: HIJSMM301E1CYJ.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacactttggccaggggaccaagctggagatcgaaacgactgtggctgcaccatctgtt

SEQ ID NO: 781821 - DNA, 502 bp, Homo sapiens
  misc_feature: HIJSMM301CQLPF.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggccaaaccgatatgcttattggtaccagcagaagccgggccaggcccctgtgttggtgatgtataaagacactgagaggccctcagggatccctgagcgattctctggctccaggtcagggacaacggtcacaattggccatcagtggagtccaggcagaggacgaggctgactatattgtcaatcaacagacaccattggtacttatgttactttcggaactgcgaaccaaggtccacgtcctgggtccagccaacggcccaaccccactgt

SEQ ID NO: 781822 - DNA, 505 bp, Homo sapiens
  misc_feature: HIJSMM301CEG1L.4.39.D06.1.454.light.4.raw
  modified_base (450)..(450): a, c, t, g, unknown or other
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtacccaacaacacccaggcaaagcccccaaattcataatttatgaggtcactaagcggccctcaggggtccctgatcgcttctctgcctccaaggctggcaacacggcctccctcgaccgtctctgggctccaggctgaggatgaggctgattattattgcagctcatatgcaggcagttacaattggtnatattcggcggagggaccaaactgaccgtctaggtcagcccaaggctgccccctc

SEQ ID NO: 781823 - DNA, 522 bp, Homo sapiens; identical to SEQ ID NO: 543352
  misc_feature: HIJSMM301AVUOH.27.23.C01.1.454.light.4.raw

SEQ ID NO: 781824 - DNA, 456 bp, Homo sapiens
  misc_feature: HIJSMM301EFVHH.19.86.H09.1.454.light.4.raw
tactctcgtgcacgaccggtgctcgatttagtgctatagacttggggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaaagctgaccgtcctaagtcagcccaaggctgccccctcggtcactctgttcccgccctcctccacgagagta

SEQ ID NO: 781825 - DNA, 494 bp, Homo sapiens
  misc_feature: HIJSMM301DHCJP.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgctaacttattactgaccaacaatatgattatttattctccagcgttcggccgaggggaccaaggtggaagtcaagcgaactgtggctgcaccatctcgtt

SEQ ID NO: 781826 - DNA, 500 bp, Homo sapiens
  misc_feature: HIJSMM301EXQKA.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggctagttattactgtcagcaatattatattcctcctcagacgttcggaccaagggaccaaggtggaaatacaaacgaactcgtggctgcacc

SEQ ID NO: 781827 - DNA, 497 bp, Homo sapiens
  misc_feature: HIJSMM301C8IBB.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtggggtcggggtcagagttcactctcaccatcagcagcctgtagtctgaagtattttgctagttttattactgtcagcagtatgatacctcggcctccgtactacttttgggccgggggaccaagctggaatcaagcgaactgtggctgcaccatctgttcttc

SEQ ID NO: 781828 - DNA, 491 bp, Homo sapiens
  misc_feature: HIJSMM301AGHYG.12.31.C09.1.454.light.4.raw
atacgacgtacacgaccggtgctcgatttagacgtctcatcaaggaaggaaggggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcactttcggccaaggacacgaccgcagattggacgaactggtggctgcaccat

SEQ ID NO: 781829 - DNA, 513 bp, Homo sapiens
  misc_feature: HIJSMM301BAR9J.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggttttctcatcgctttctctggctccaaatctggcaacacggccctccctgaccatctctgggctgagtctggaggacgaggctgattacttctgttgctcttgggcaactactgtcgtttgggtgttcggcggagggaccaagttgaccgtcctaggtcagcccaagctcgccccctcggtcactctcgtt

SEQ ID NO: 781830 - DNA, 499 bp, Homo sapiens
  misc_feature: HIJSMM301CGRT7.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgtattcgacagacaagcagtgggtagtcagggggtcttcgggcggagggacgaaagctgaccgtcctgagtcagcccaaggctgccccctcggtcactt

SEQ ID NO: 781831 - DNA, 507 bp, Homo sapiens
  misc_feature: HIJSMM301E2ZH0.41.14.B03.1.454.light.4.raw
tctatactatcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatataacaagcagcagcactctcgtggtattcggcggagggaccaagctgaccgtcctacggtcacgcccaacggctgccccctcc

SEQ ID NO: 781832 - DNA, 507 bp, Homo sapiens; identical to SEQ ID NO: 635523
  misc_feature: HIJSMM301AOBAK.8.28.C06.1.454.light.4.raw

SEQ ID NO: 781833 - DNA, 493 bp, Homo sapiens
  misc_feature: HIJSMM301BSAHN.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttatttttgtcaacaggctaacactttccccctcactttcggcggagggaccaaggtggagatcaagacgaactgtggctgcaccatctgtctt

SEQ ID NO: 781834 - DNA, 517 bp, Homo sapiens
  misc_feature: HIJSMM301AK8GK.40.47.E03.1.454.light.4.raw
tctagcgactcacgaccggtgctcgatttagactcgcgcacagagagaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaaagccccccaaatcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaaataatttggtgttcgggcgggggaccaagctgaccgtcctggtccagcccaaggctcgccccctcggtcactcttccg

SEQ ID NO: 781835 - DNA, 463 bp, Homo sapiens
  misc_feature: HIJSMM301C98LK.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctcgccccctcggtcactctcgttcccaccctcctcctatcta

SEQ ID NO: 781836 - DNA, 498 bp, Homo sapiens
  misc_feature: HIJSMM301AYODY.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgctagtttattactgtcagcagcgtagcaactccctcacgttcggcggagggaccaaggtggagatcaaacgaactgtggctgcaccatctgttcttcatccttcccgcc

SEQ ID NO: 781837 - DNA, 507 bp, Homo sapiens
  misc_feature: HIJSMM301AE6CB.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgttcagcagcgtagcaactggcctcggttctacttttggccgtaggggaccaagctggagatacaaacgaactgtggctgcaccatctgtcttcattccc

SEQ ID NO: 781838 - DNA, 489 bp, Homo sapiens
  misc_feature: HIJSMM301BX3C8.47.36.D03.1.454.light.4.raw
  modified_base (479)..(479): a, c, t, g, unknown or other
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcatatcagcagcctgcagcctgaagtattttggaactttattattgtcaacagggtaacagtttcccgctccaccttcggcggagggaccaaggtggagatgaaaagactgnggctgcacat

SEQ ID NO: 781839 - DNA, 504 bp, Homo sapiens
  misc_feature: HIJSMM301DXE1Q.21.81.H04.1.454.light.4.raw
  modified_base (464)..(464): a, c, t, g, unknown or other
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctcctgaccatctctgggctccaggctgatgacgaggctgattattactgcaggtcatatacaatcagcaacacttactgtcttcgggactgggaccaagntcaccgtcctaggtcagcccaaggcccaacccactgtcta

SEQ ID NO: 781840 - DNA, 516 bp, Homo sapiens
  misc_feature: HIJSMM301A30TE.14.70.G04.1.454.light.4.raw
cgtctagtaccacgaccggtgctcgatttagtgtagtgtgaagggaaaggggagggcagttggtagatgcccctctgggagagatccccagggggtgacagccatggaccctggaagggcctgggctagggacagggaccagagccagtccagggagaggacagagccaatggactggggtgtactgtaacagccctgctggcgagagggaccagggcaccgtcatccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaaagcggggacccagaccctggagcctcagttggaagcagccgatcagcctgcggagcctgtggggcaggtcagcccaaggcccaaccccactgtcact

SEQ ID NO: 781841 - DNA, 506 bp, Homo sapiens
  misc_feature: HIJSMM301AE5U4.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctacggtcacgcccaaggctcgcccccgtcc

SEQ ID NO: 781842 - DNA, 495 bp, Homo sapiens
  misc_feature: HIJSMM301EU10Y.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcgccaagggaccaaggtggaaatcaaacgactagtggctgcacca

SEQ ID NO: 781843 - DNA, 487 bp, Homo sapiens
  misc_feature: HIJSMM301CT628.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagtattttgctagttttattactgtcagcagtatcataactggccgctcaccttcggccaagggacacgactggagattaaacgaactgtggctgcacat

SEQ ID NO: 781844 - DNA, 485 bp, Homo sapiens
  misc_feature: HIJSMM301AEYPU.13.87.H10.1.454.light.4.raw
  modified_base (365)..(365): a, c, t, g, unknown or other
  modified_base (459)..(459): a, c, t, g, unknown or other
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcgcagtggatctgggacagaattcactctcacaatcancagcctgcagcctgaagattttgcaacttattactgtcaacagcttaatagttaccgctcagtttcggcggagggaccaaggtggagatcaaanaactgtggctgcacatctgtcttcta

SEQ ID NO: 781845 - DNA, 307 bp, Homo sapiens
  misc_feature: HIJSMM301BQX5T.19.85.H08.1.454.light.4.raw
  modified_base (303)..(303): a, c, t, g, unknown or other
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtatcagtggtccaggcaggactgactcagccaccctcggtgtccggggcctgggacaggccgccacagtcacctgcaccgggaacaccaacaatgtcggcgaccagggagccgcttggctgcagcaacgccagggccaaccctcccaaactcctgtcgtacagatgnacgc

SEQ ID NO: 781846 - DNA, 544 bp, Homo sapiens
  misc_feature: HIJSMM301BBVWT.27.23.C01.1.454.light.4.raw
  modified_base (393)..(393): a, c, t, g, unknown or other
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctaccngcctggaggacgaggctgattattatgtagttcatatacaaccagtgacacgttgggtgttcgggcggtagggaccaggctcggaccgttcctaggtcacggcccaaggctcggccccctcggtccacttcctgttccccaccccttcccg

SEQ ID NO: 781847 - DNA, 516 bp, Homo sapiens
  misc_feature: HIJSMM301ADZUM.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaaggctgaccgtcctaggtcagcccaaggctgccccctggtcactctgtccc

SEQ ID NO: 781848 - DNA, 523 bp, Homo sapiens
  misc_feature: HIJSMM301DRX64.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactggtggagagagccacacaattgatggccaaggacggttggggtggttcggcgggagggaccaaggctggaccgtcctaggtcaggccccaaggctcgccccctcggtccactctgttccccgccctcctcgctacgt

SEQ ID NO: 781849 - DNA, 502 bp, Homo sapiens; identical to SEQ ID NO: 641568
  misc_feature: HIJSMM301BGJ5I.5.86.H09.1.454.light.4.raw

SEQ ID NO: 781850 - DNA, 502 bp, Homo sapiens
  misc_feature: HIJSMM301DYKY2.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgctagtttattactgtcagcagtatgatacctggcctccgtactacgttttcggccgggggaccaagcgtggaaatctaaggcaactgtggctggcacatctgtcttcattccc

SEQ ID NO: 781851 - DNA, 502 bp, Homo sapiens
  misc_feature: HIJSMM301APGRJ.16.71.G05.1.454.light.4.raw
tgtactactccacgaccggtgctcgatttagtgtcgtcgcaagagagaggggggagagctgctcagttaggacccagagggaaccatggaaacccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccgggctcctcatctatggtgcatccagcagggccactggcatcccagacaggttcagtggcagtgggtctgggacagacttcactctcaccctcagcagactggagcctgaagtattttgcagtgttattactgtcagcagtatggtagggcaccttacacttttggccacggggaccaagctggagatcaaacgaactagtgctgcaccatctgtcttcta

SEQ ID NO: 781852 - DNA, 494 bp, Homo sapiens
  misc_feature: HIJSMM301B7RUI.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaatcaagcagggtggaggctgaggatgttattgggctctattattgcatgcaagcaacacactggccgtacacttttggccaggggaccaagctggagatcaatcaactgtggtcg

SEQ ID NO: 781853 - DNA, 502 bp, Homo sapiens
  misc_feature: HIJSMM301CCDS8.16.86.H09.1.454.light.4.raw
  modified_base (452)..(452): a, c, t, g, unknown or other
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagtctgcctccgtgtctgggtctcctggacagtcgatcatcatcttctgcactggatccagcagtgacgttggtagttataattatgtctcctggtaccaacagtacccaggcaaagcccccaaactcatgattttatgaggtcagtaatcggccctcaggggtttctaatcgcttctctggctccaagtctggcaacacggcctccctgaccgtctctggcctccagactgaggacgaggctgattattacttgccactcatatagaagtagtactaactcctntggtttttcggcggagggaccgaagctgaccgtcctaggtcagcccaagg

SEQ ID NO: 781854 - DNA, 528 bp, Homo sapiens
  misc_feature: HIJSMM301B4SGY.8.43.D10.1.454.light.4.raw
ctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttggggccaaagctgccctgacactgtcaggtgtgcagcctgaggacgaggctgagtattactgcctgctctattatggtgggcctttgggtgttcggcggagggaccaagttcggaccgtcctaggtcagcccaaggctcgccccctcggtccacgtctcgttccccaccctcctccgacacgcgacg

SEQ ID NO: 781855 - DNA, 500 bp, Homo sapiens
  misc_feature: HIJSMM301BRX8A.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctggaggacgaggctgatttattactgcagctcatatacaagcaccagcactctctatgtcttcggaactgggaaccaaggtcaaccgtctaagtcagcccaagg

SEQ ID NO: 781856 - DNA, 500 bp, Homo sapiens
  misc_feature: HIJSMM301E1JPY.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcattaatacaaagcaaccagccactctctatgtcttcggaactgggaccaaggtcaccgtctaggcagcccaagg

SEQ ID NO: 781857 - DNA, 492 bp, Homo sapiens
  misc_feature: HIJSMM301A6GBO.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagccctccctggccatcagtgggctccggtccgaggatgaggctgatttattattgtgcaacatgggatagtagcctgagtagtgtggttttcggcggagggaaccaaactgaccgtcctaggtcagcccaaggctcgccccctccggtcactctcgttccccaccctcctcctacgtgagt

SEQ ID NO: 781858 - DNA, 519 bp, Homo sapiens
  misc_feature: HIJSMM301A6MIG.17.33.C11.1.454.light.4.raw
  modified_base (426)..(426): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactacctggacccctgcccgattctcaggctccctccttggggcaaagctgccctgacactgtctggtgtgcagcctgaggacgaggctgactattactgcctactctactttggnggtgctgtgctattcggcggaggaccaagctgaccgttctaagtcagcccaaggctcgccccctcggtcacctctcgttcccaccctcctacc

SEQ ID NO: 781859 - DNA, 515 bp, Homo sapiens
  misc_feature: HIJSMM301AF6KQ.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgacccgtctctggcctccagactgaggacgaggctgattattactgccactcatatagaagtagtactactcctgtggttttcggcggagggaccaagctgaccgtcctaggtcagcccaaggctgccccctcggtcactctgttccccg

SEQ ID NO: 781860 - DNA, 494 bp, Homo sapiens
  misc_feature: HIJSMM301CHHMJ.43.37.D04.1.454.light.4.raw
tgtgagtagtcacgaccggtgctcgatttagtagcatactgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctcttcgtcatcactggtctacagtctgacgacggcgcaatgtacttctgtcaacactatcgcctctccccctacaactttcgtcgaggggaccaaggttgaacatcaatcgaactgtggctgcaccta

SEQ ID NO: 781861 - DNA, 511 bp, Homo sapiens
  misc_feature: HIJSMM301AV1DL.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcacgacccaaggacccaaccccatcgtcta

SEQ ID NO: 781862 - DNA, 443 bp, Homo sapiens
  misc_feature: HIJSMM301DWGZL.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcacgcccaaggctcgcccctcggtcactctcgtccccgccctcctcatagtataga

SEQ ID NO: 781863 - DNA, 494 bp, Homo sapiens; identical to SEQ ID NO: 534992
  misc_feature: HIJSMM301AMUPQ.9.1.A01.1.454.light.4.raw

SEQ ID NO: 781864 - DNA, 503 bp, Homo sapiens
  misc_feature: HIJSMM301BFLO7.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaacgcccccaaactcatgatttatgatgtcagtaatcggccctcagggtttctaatcgcttctctggctccaagtctggcaacacggcctccctgaccatctctgggctccgaggctgaggacgaggctgattattactgcagctcatatacaagcagcagcactctcgtggtattcggcggagggaccaagctggaccgtccgtaggtcagcccaaggctcccgg

SEQ ID NO: 781865 - DNA, 493 bp, Homo sapiens
  misc_feature: HIJSMM301BUDZ7.9.34.D01.1.454.light.4.raw
tgatacgtctcacgaccggtgctcgatttagatcgtctgtgttggggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctcaggctgaggatgaggctgacctagttactgccagtcgtatgacagtggcctaagtaacatcgtcttcggaactgggaccaaggtcacgtcg

SEQ ID NO: 781866 - DNA, 488 bp, Homo sapiens
  misc_feature: HIJSMM301EJAPO.40.15.B04.1.454.light.4.raw
tctagcgactcacgaccggtgctcgatttagacagtatatatccgcgggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgttggcaaccaaggagcaacttggctgcagcagcaccagggccaccctcccaaagtcctatccgacaggaataacaaccggccctcagggatctcagagaggaatatctgcatccaggtcaggaaacacagcctccctgaccattactggactccagcctgaggacgaggctgactattattgctcagcatgggacaccacgctcaatgccgcggtattcggcgcagggaccgaagcctgaccgtcctaggtcacg

SEQ ID NO: 781867 - DNA, 484 bp, Homo sapiens
  misc_feature: HIJSMM301BVYF9.7.67.G01.1.454.light.4.raw
cgtgtctctacacgaccggtgctcgatttagagtatacatattgggtttgggggctctgcttcagctgtggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagccccccaaactcctcatatacgagaacaccaatcggccctcaggacgtccctgaccgattcctctggctccaagtctggcacctcagcctccctggcccatcactgggctccaggctgaggatgaggctgattattactgccagtcgtatgacagcagcctgagttgtttgggtgttcggcggaggacccg

SEQ ID NO: 781868 - DNA, 518 bp, Homo sapiens
  misc_feature: HIJSMM301B9OUL.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccagggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcacgcctgaggatgaggctgagtattactgcttgctctcctatagtggtggttcgggtgttcggcggagggaccaagctgaccgtcctaggtcagcccaaggctgccccctcggtcactctcgttccccaccctcctcctagtctacg

SEQ ID NO: 781869 - DNA, 525 bp, Homo sapiens
  misc_feature: HIJSMM301DGVTU.5.58.F03.1.454.light.4.raw
  modified_base (225)..(225): a, c, t, g, unknown or other
atcagacacgcacgaccggtgctcgatttagtctgatcgagaaggggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttggggttataaccttgtctcctggtaccaacagcaaccaggccaaagccccctaaacttttggtttatcagggcaataagcggccctcaggggtttctaatcgcttctctggctccaagtctggcaacacggccgccctgacaatctctggctccaggctgacgacgaggctgtatttttactgctgcttcatatgcaggtgatcactaccttttatcgttcgggactgggaacctaaggtcaccgtcctaggtcagcccaacggcccaaccccactgtcactcttccg

SEQ ID NO: 781870 - DNA, 508 bp, Homo sapiens
  misc_feature: HIJSMM301DF5Q1.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgtttggggtttattacgtgcatgcaaggtctaccaaacccgactcaccttcggccgagggacacgcctggagaattaaacgaacgtgtggctgcaccatcttcg

SEQ ID NO: 781871 - DNA, 509 bp, Homo sapiens
  misc_feature: HIJSMM301C37DO.10.27.C05.1.454.light.4.raw
  modified_base (468)..(468): a, c, t, g, unknown or other
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttctaaggttttcggcgggagggaccnggctgaccgtcctaagtcagcccaaggctcgccccctcggt

SEQ ID NO: 781872 - DNA, 506 bp, Homo sapiens
  misc_feature: HIJSMM301A1F7P.51.9.A09.1.454.light.4.raw
  modified_base (434)..(434): a, c, t, g, unknown or other
cgatcgtatacacgaccggtgctcgatttagcgagacgcgcaggggtccaaacagagcttcagcaagcatagtgggaatctgcaccatgccctgggctctgctcctcctgaccctcctcactcactctgcagtgtcagtggtcccggcaggactgacgcagccaccctcggtgtccaagggcttgagacagaccgccacactcacctgcattgggaactactacaatgtgggcgaccaaggaacactttggctgcagcagtaccagggccaccctcccaaactcctgtcctacagggataatacccggccctcagggatctcagagagattctcagcttccacgtcaggatacacagccctccctgaccattactggactccagccgtggggacgaggctgactattactgctcagcgtgggacagcagcctcngagcttgggtgttcggcggagggaccagggctggacccgtcctgacgtcacgcccaaggcctggtccccccg

SEQ ID NO: 781873 - DNA, 512 bp, Homo sapiens
  misc_feature: HIJSMM301B8AGY.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcagggtccctgatcgcttctctggctccaagtctggcaacacggcctccctgaccgtctctgggctccaggctgaggatgaggctgattattactgcagctcatatgcaggcagcagcagtccccatgtgatcgttcgggcggggggaccaaggctgaccgtcctaggtcagcccaaggcctcgtccccccg

SEQ ID NO: 781874 - DNA, 536 bp, Homo sapiens
  misc_feature: HIJSMM301AHT52.22.14.B03.1.454.light.4.raw
acatacgcgtcacgaccggtgctcgatttagtgtgagtagttccgcgggggaggctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctggaagatgtggcagttttattattgtcagcaaattatttagtatttccctacctcgacgtaccgtttcgggccgtaaacggggacccaaagggtagggaaaactacgaaaaccgaacgtgtaggcctggcaccctaa

SEQ ID NO: 781875 - DNA, 511 bp, Homo sapiens
  misc_feature: HIJSMM301DYSJ3.41.23.C01.1.454.light.4.raw
  modified_base (408)..(408): a, c, t, g, unknown or other
tctatactatcacgaccggtgctcgatttagtacacgtgattagggattggggggggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgacatcactgtcaancagcagacagtagtggtttcttattgggttggttcgggacgggaggggaccaaaggctggtaccgttccgtaggtccaggcccaaggcctcgccccctcgggt

SEQ ID NO: 781876 - DNA, 505 bp, Homo sapiens; identical to SEQ ID NO: 535503
  misc_feature: HIJSMM301AS578.8.28.C06.1.454.light.4.raw

SEQ ID NO: 781877 - DNA, 499 bp, Homo sapiens
  misc_feature: HIJSMM301ATGHB.48.4.A04.1.454.light.4.raw
agtatacatacacgaccggtgctcgatttagagtagtgatcgagggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtcccctcaaggttcagcggcagtggctcttggacggatttcactctcaccatcaccagtcttcaggctgaagatttaggaattttactactgtcagcagacttacagtgttccgtacacttttggccaggggaccaaacgtggagatagaacgaactgtggctgcaccatctgtcttcatccttccccg

SEQ ID NO: 781878 - DNA, 515 bp, Homo sapiens
  misc_feature: HIJSMM301A8MBD.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctgactcccagtttcagataccaccggagagattgtgttgacacagcctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgctagtttattactgtcaacatcgtaccgagtcggccgtccgggggcctacgtttccggcccgtcgggaccaaaggtggatatacaaacgaactgtggctgcaccatctgtctt

SEQ ID NO: 781879 - DNA, 495 bp, Homo sapiens
  misc_feature: HIJSMM301EZJTA.48.27.C05.1.454.light.4.raw
agtatacatacacgaccggtgctcgatttagacgcgatcgaagggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctcctgaccgtctctgggctccaggctgaggatgaggctgattattaactgcagctcatatgcaggcagcaacaatgtggtattcggcggaggaccaagctgaccgtcctaggtcagccaaggctcg

SEQ ID NO: 781880 - DNA, 508 bp, Homo sapiens
  misc_feature: HIJSMM301D8778.18.78.H01.1.454.light.4.raw
  modified_base (504)..(504): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctggaggacgaggctgattattactgcagctcatatacaagcaccagcactctctatgtcttcggaactgggaccaaggtcaccgtcctaggtcagcccaaggccaaccccnctgt

SEQ ID NO: 781881 - DNA, 506 bp, Homo sapiens
  misc_feature: HIJSMM301AMUU3.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgctagtttattactgtcaacagcgtagcagcaggcctccggcgacgttcggcaagggaccaaggtggaagtcagcgaactgtggctgcaccatctgtcttcatcttccgcc

SEQ ID NO: 781882 - DNA, 526 bp, Homo sapiens
  misc_feature: HIJSMM301EPOP1.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttggggtgttcgggcggagggaccaggctgaccgtcctaggtcagcccaaggctcgccccctcggtcactctcgttcccgcctccc

SEQ ID NO: 781883 - DNA, 530 bp, Homo sapiens
  misc_feature: HIJSMM301E1KUA.41.19.B08.1.454.light.4.raw
tctatactatcacgaccggtgctcgatttagtgagtcagtaagggggcgtgggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtacctaggtccaggccccaaggccaaacccccactcgtcactctcgttcccgccctcct

SEQ ID NO: 781884 - DNA, 493 bp, Homo sapiens; identical to SEQ ID NO: 592504
  misc_feature: HIJSMM301D1IL2.22.5.A05.1.454.light.4.raw

SEQ ID NO: 781885 - DNA, 498 bp, Homo sapiens
  misc_feature: HIJSMM301DLXFC.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctggaggacgaggctgattattactgcagctcatatacaagcagcagcactcaagtcttcggactgggaccaaggtcaccgtctaggtcagcccaaggcccaaccc

SEQ ID NO: 781886 - DNA, 522 bp, Homo sapiens
  misc_feature: HIJSMM301ENB2S.41.19.B08.1.454.light.4.raw
tctatactatcacgaccggtgctcgatttagtgagtcagtaaggggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccccactgtcactctgttcccaccctcct

SEQ ID NO: 781887 - DNA, 505 bp, Homo sapiens
  misc_feature: HIJSMM301AJ6EO.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggtactttattactgtcagcagcgtgagttctcggcctccgctctacgtttcggcgggagggaccgagggtcggagatacaaacgaactgtggctgcaccatctgtcttcacttccc

SEQ ID NO: 781888 - DNA, 505 bp, Homo sapiens
  misc_feature: HIJSMM301BWZVA.8.24.C02.1.454.light.4.raw
ctcgcgtgtccacgaccggtgctcgatttagtacagatcgttagggaaagggggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagagcccccaaactcatcatttatgatgtcactgatcgccctcaggggtttcgaatcgcttctctggctccaagtctggcaacacggcctccctgaccatctctgggctccaggctgaggacgaggctcattattattgcagttcatatacgaccagcagcactctcgtggtcttcggcggagggaccaagtgaccgtctaacgtcagcccaaggctgccccctcgg

SEQ ID NO: 781889 - DNA, 505 bp, Homo sapiens
  misc_feature: HIJSMM301BV78R.15.1.A01.1.454.light.4.raw
tctacgtagccacgaccggtgctcgatttagacgtctcatcagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctccggtcactt

SEQ ID NO: 781890 - DNA, 469 bp, Homo sapiens; identical to SEQ ID NO: 553255
  misc_feature: HIJSMM301ERI44.7.81.H04.1.454.light.4.raw

SEQ ID NO: 781891 - DNA, 499 bp, Homo sapiens
  misc_feature: HIJSMM301AV2F1.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactcctcaccatcaccaacctgcaggctgaagatgtggcagtttattactgtcagcaatactatagtcctcctctcacgttcggcggagggaccaaggtggacatcaagcgaactgtggctgcaccatctgt

SEQ ID NO: 781892 - DNA, 512 bp, Homo sapiens
  misc_feature: HIJSMM301A25VI.8.42.D09.1.454.light.4.raw
ctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttagaccgtcctaggtcagcccaaggctcgccccctcggtaacctctcgttcccgt

SEQ ID NO: 781893 - DNA, 530 bp, Homo sapiens
  misc_feature: HIJSMM301ETP39.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcaacaaagaatcggtcttttggggtccctgatcgcttctctggctccatccttgggaacaaggctgccctcaccatcacgggggcccaggcagatgatgaatctaattatcactgtgtcgttgtatagttgggttttggctattttcgggtgtttcgggcgggaagggacccagggtgaccgtccctacgtcagcccaaggtcccg

SEQ ID NO: 781894 - DNA, 496 bp, Homo sapiens
  misc_feature: HIJSMM301AIB0V.27.78.H01.1.454.light.4.raw
  modified_base (492)..(492): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctctaagtgatcaccttcggccaaagggacacgactggagattaaacgaactgtggctgcaccatctntctt

SEQ ID NO: 781895 - DNA, 494 bp, Homo sapiens
  misc_feature: HIJSMM301A0IIX.49.42.D09.1.454.light.4.raw
agtcgagagacacgaccggtgctcgatttagacacatacgcagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagaagttacggaaacttgactctattttcggcggagggaccaaggtggagatcaaacgaactgtggctgcaccatctgtctt

SEQ ID NO: 781896 - DNA, 509 bp, Homo sapiens
  misc_feature: HIJSMM301ADTNA.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttcacctccaggacacaaaatacagcctctctgaccattactggtctccagcctgacgacgaggctgactactactgctcagcctgggacaccagcctcgctgcttcggcttttcggcggagggaccaagctgaccgtcctgggtcacgcccaaggctcgccccctcggtctacc

SEQ ID NO: 781897 - DNA, 505 bp, Homo sapiens
  misc_feature: HIJSMM301D9YOP.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaaccaggacatcgtcctgcactgctcatttactgggcgtctacccgggaatccggggtccctgaccgattcagtggcagcgggtctgggacagatttcaactctcaccatcagcagcctgcaggctgaagatgtggcaagtttattattgtcagcaaatattatattcctctcagacgttggcctaagggccaaaggtggaaatcaaaacgaactgtacggctagcaccct

SEQ ID NO: 781898 - DNA, 502 bp, Homo sapiens
  misc_feature: HIJSMM301E300O.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaatagtccgctcacttcggcgggggaccggaaggtggagttcaaacgaacgtacgtggctgcgaccactactgtcttctatt

SEQ ID NO: 781899 - DNA, 530 bp, Homo sapiens
  misc_feature: HIJSMM301C9RME.27.23.C01.1.454.light.4.raw
  modified_base (523)..(523): a, c, t, g, unknown or other
agcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcgggagggaccaggctgaccgtctaggtcagcccaaggctcgccccctcggtccactcctcgttcccnccctccc

SEQ ID NO: 781900 - DNA, 498 bp, Homo sapiens
  misc_feature: HIJSMM301AHTHP.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatggaggccgactactactgtcaggtgtgggatttcactactgatcatgtggggtcttcggcggagggccaagctgaccgtctaagtcagccaaggctcgcccctgcta

SEQ ID NO: 781901 - DNA, 490 bp, Homo sapiens
  misc_feature: HIJSMM301DD7X2.8.12.B01.1.454.light.4.raw
ctcgcgtgtccacgaccggtgctcgatttagtagtgtagattccgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctcaactctgggaacacagccactctgaccatcagcgggacccaggctacggatgaggctgactattactgtcaggcgtgggacagcagcacctatgtggttttcggcggagggaccaagctgaccgttcctggtcagacccaacggctcgtccccccg

SEQ ID NO: 781902 - DNA, 519 bp, Homo sapiens
  misc_feature: HIJSMM301CMUI2.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgctagtttattactgtcaacatcgtaccgagtggccgtccggggccaccgtttccggcccgtgggacccgaaaggtaggagtatacaaacgaactgtggctgcaccatctgtcttcta

SEQ ID NO: 781903 - DNA, 460 bp, Homo sapiens
  misc_feature: HIJSMM301B30RI.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatggggatgacaccctgaatggtccttgtgtggttttcggcggagggaccaagctgaccgtctaggtcagcccaaggctgccccctcggtcactctgttcccgccctcctcgtatctctcg

SEQ ID NO: 781904 - DNA, 513 bp, Homo sapiens
  misc_feature: HIJSMM301E24BV.43.23.C01.1.454.light.4.raw
  modified_base (445)..(445): a, c, t, g, unknown or other
  modified_base (499)..(499): a, c, t, g, unknown or other
tgtgagtagtcacgaccggtgctcgatttagtacacgtgattagggattggggtggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtgcgcgtgggtgttcggnggaggaccaagctgaccgtctgggtcagcccaaggctgccccctcggtcactcngttcccgccctcct

SEQ ID NO: 781905 - DNA, 514 bp, Homo sapiens
  misc_feature: HIJSMM301BLMBP.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgagggccggggatgaggccgactattattgtcaggtgtgggataatggcagtgatcatgttcttattcggcgggagggaccacgctgacccgtcctaagtcagcccaaggctcgccccctcggtccactctcgttccccaccc

SEQ ID NO: 781906 - DNA, 484 bp, Homo sapiens; identical to SEQ ID NO: 632848
  misc_feature: HIJSMM301BNLME.26.45.E01.1.454.light.4.raw

SEQ ID NO: 781907 - DNA, 490 bp, Homo sapiens; identical to SEQ ID NO: 560265
  misc_feature: HIJSMM301B47BU.3.33.C11.1.454.light.4.raw

SEQ ID NO: 781908 - DNA, 491 bp, Homo sapiens
  misc_feature: HIJSMM301DMQ6N.40.10.A10.1.454.light.4.raw
tctagcgactcacgaccggtgctcgatttagcgtcgatctcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccacggggaccaaacggtaggtagtgttacaaccgaaacctgttcggcttgcaccta

SEQ ID NO: 781909 - DNA, 489 bp, Homo sapiens
  misc_feature: HIJSMM301EQ1RF.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactagaaaatcagcagagtggaggctgaggatggttgggctcgtattattgcagtgcaagctctacaagtcccgctcactttcggcggagggaccaagggtggagatcaaacgaa

SEQ ID NO: 781910 - DNA, 509 bp, Homo sapiens
  misc_feature: HIJSMM301A6RFA.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcaggaggacgaggctgactattactgtcaatcaacagacagtagtggtacttatgtgcagttcggcggagggaccgaagctgaccgtcctagggtccaggcccaaggctcgccccctcggtcacttccg

SEQ ID NO: 781911 - DNA, 508 bp, Homo sapiens
  misc_feature: HIJSMM301BD8VS.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacacgcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaattacttttgtcttcggaacgtgggaccaaggtccaccgtcctaggtcacgcccaacggcccaaccccactcgtcactctcgttcccacccctcctcgagtagtaca

SEQ ID NO: 781912 - DNA, 492 bp, Homo sapiens
  misc_feature: HIJSMM301C6F2Q.26.23.C01.1.454.light.4.raw
  modified_base (458)..(458): a, c, t, g, unknown or other
  modified_base (465)..(465): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattactccagcgttcggccaggggaccaaacggnggaagtnaagcgaactgtggctgcaccatctgtt

SEQ ID NO: 781913 - DNA, 516 bp, Homo sapiens
  misc_feature: HIJSMM301CIYU4.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacggaggctcattactactgctgctcatatggaggttatagcacttgggtgttcggcggcgggaccaaagtgaccgtctaagtcagccaaggctgccccctcggtcactctgttcccaccct

SEQ ID NO: 781914 - DNA, 517 bp, Homo sapiens
  misc_feature: HIJSMM301EKOPL.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggcccaccctcccaaactcctgtcgtacaggaatgacaaccggccctcaaacatttcagagagattttctacctccaggactacaaaatacagcctctctgaccattactggtctccagcctgacgacgaggcctgactactactgctcagcctgggacacccagcctcgctgtcttggtcttttcggacgggagggaccaagctcgaccggtcctgggtcagcccaaggctgccccctcggtcaccg

SEQ ID NO: 781915 - DNA, 492 bp, Homo sapiens
  misc_feature: HIJSMM301BMLQ6.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtgggtcccatcaaggttcagcggcagtaggtctgggacagagttcactctcactatcagcggcctgcagcctgaagattctgcaacttattactgtctccagtatgatgctttacccctggactttcggtccgaacgggaccgaaggtaggaaatacaaacgaactacgtggctgcaccta

SEQ ID NO: 781916 - DNA, 512 bp, Homo sapiens
  misc_feature: HIJSMM301C30Y5.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcgaggggtttctattcgcttctctggctccaagtctgacaacacggcctccctgacaatctctgggctccaggctgaggacgaggctgatttattactgctgctcatatgcagatggtgacacctcccggtggtattcgggcggagggaccaaggtcgaccgtcctaggtcacgcccaaggctcgccccccg

SEQ ID NO: 781917 - DNA, 515 bp, Homo sapiens
  misc_feature: HIJSMM301DJ378.52.57.F02.1.454.light.4.raw
cgcagtacgacacgaccggtgctcgatttagctcgatatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacggttggtgcttatgactttgtctcctggtaccaacaccaccctggcaaagccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaataagtttgggggtttcggcggaagggaccaaggtcgaccgtcctacgtcagcccaaggctcgcccctggtcact

SEQ ID NO: 781918 - DNA, 537 bp, Homo sapiens
  misc_feature: HIJSMM301CHZCZ.9.12.B01.1.454.light.4.raw
tgatacgtctcacgaccggtgctcgatttagtagtgtagattccgcggggacgaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggacaatccggggtccctgaccgattcagtggcagcgggtctgggacagatttcactctcaccatcagcagcctgcaggctgaagatgtggcagtttattactgtcaacgtagttttcgtcgggtcgttcggtccgaacgggaccgaaggtaggaaagtacgaaacgtaaccgtaggtggacttcggcaccgtatcgttcgtcttccgtactcctttcccccg

SEQ ID NO: 781919 - DNA, 513 bp, Homo sapiens
  misc_feature: HIJSMM301BAA5R.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctaggcaacacggcctccctgaccgtctctgggctccagcctgaggatgaggctgattattacttgcagctcatatgcaggcatcaacacttggtttacggtcgggaagggaccaagctcgaccgtccgtaggtcagccccgaaggccgtcgtccccccg

SEQ ID NO: 781920 - DNA, 504 bp, Homo sapiens
  misc_feature: HIJSMM301BO09Y.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcgggggacaagctgccgtcctacgtcagcccaaggctcgccccctcggtctactctgttcccccg

SEQ ID NO: 781921 - DNA, 497 bp, Homo sapiens
  misc_feature: HIJSMM301ARORV.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgtcgtccaggaccgaacggtaggaagtacaaagaaactagtaggcgtgcgaccatacttcg

SEQ ID NO: 781922 - DNA, 502 bp, Homo sapiens; identical to SEQ ID NO: 626890
  misc_feature: HIJSMM301CCTXK.5.86.H09.1.454.light.4.raw

SEQ ID NO: 781923 - DNA, 417 bp, Homo sapiens; identical to SEQ ID NO: 652373
  misc_feature: HIJSMM301EVNI5.18.78.H01.1.454.light.4.raw

SEQ ID NO: 781924 - DNA, 506 bp, Homo sapiens
  misc_feature: HIJSMM301DKMQV.9.71.G05.1.454.light.4.raw
tgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagtatattcggcggagggaccaggctgaccgtcctgagtcagcccaaggctgccccctggcactctcgttccccaccctcctcacggactatctacg

SEQ ID NO: 781925 - DNA, 504 bp, Homo sapiens
  misc_feature: HIJSMM301B80FI.12.86.H09.1.454.light.4.raw
atacgacgtacacgaccggtgctcgatttagtgctatagacttgggtttggggggagggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttggctagtttattactgtcagcagcgtagcaactggcctcggttctacttttggccgaggggaccaagctggagatcaaacgaactagtggctgcaccatctgtcttc

SEQ ID NO: 781926 - DNA, 479 bp, Homo sapiens
  misc_feature: HIJSMM301AXKDK.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatgtaacagcaatcggccctcgaggggtccctgaccgattctctggctccaagtctggcacctcagcctccctggtcatcgctgggctccaggctgacgatgaggctgtattattattgccagtctatgacaacacctgcgttggttttgctgttcggcggcgggac

SEQ ID NO: 781927 - DNA, 498 bp, Homo sapiens
  misc_feature: HIJSMM301EB7RG.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctcctgaccatctctgggctcgagtctgaggacgaggctgattacttctgttgctcttggcactactgtcgtttggtgttcggcggagggaccaagttgaccgtctaggtcagccaggctcgcccctcggcactct

SEQ ID NO: 781928 - DNA, 485 bp, Homo sapiens; identical to SEQ ID NO: 733602
  misc_feature: HIJSMM301A4EYU.40.83.H06.1.454.light.4.raw

SEQ ID NO: 781929 - DNA, 488 bp, Homo sapiens
  misc_feature: HIJSMM301A8UIX.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctcctgaccgtctctgggctccagcctgaggatgaggctgattattactgcagctcatatgcaggcatcaacactgtttcggcggagggaccaagctgaccgtcctaggtcagcccaggcct

SEQ ID NO: 781930 - DNA, 504 bp, Homo sapiens
  misc_feature: HIJSMM301BHNR3.9.21.B10.1.454.light.4.raw
tgatacgtctcacgaccggtgctcgatttagtgtcgtcgcaggagggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgacccgtcctgagtcagcccaaggcctcgcccccttc

SEQ ID NO: 781931 - DNA, 496 bp, Homo sapiens
  misc_feature: HIJSMM301DDOF7.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggcctcagggatctcggagagattctctgcatccaggtcaggatacacagcctcctgaccattactggactccagcctgaggacgaggctgactattactgctcagcatgggacagcagcctccggtggtgtgggtgactcgggcgggacgggaccgaagggcctgacccggttcctaacggtccg

SEQ ID NO: 781932 - DNA, 479 bp, Homo sapiens
  misc_feature: HIJSMM301EPYWH.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatagcttcctggtatcagcagaagccaggccagtcccctgtgctggtcatctatcaacataatcagcggccctcaggtattcctgagcgattctctggctccagttctgggaacacagccactctgaccatcagcgggacccaggctaatggatgaggctgactattactgtcaggcgtgggacatcagcagtgaggtggttttcgggcggtagggaccgaagctgaccggtcctaagtca

SEQ ID NO: 781933 - DNA, 499 bp, Homo sapiens
  misc_feature: HIJSMM301DSMKG.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcgtaactgacgaccaaggtcaccgtcctgggtcagcccaaggccaacccgactcgtcacctcttt

SEQ ID NO: 781934 - DNA, 460 bp, Homo sapiens
  misc_feature: HIJSMM301CGG6C.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcaagcatgggatgacaccctgaatggtccttgtgtggtttcggcggagggaccaagctgaccgtcctaggtcagccaaggctgccccctcggtcactctcgttcccaccctcctcgtatctctcg

SEQ ID NO: 781935 - DNA, 447 bp, Homo sapiens; identical to SEQ ID NO: 535201
  misc_feature: HIJSMM301A1DSA.18.9.A09.1.454.light.4.raw

SEQ ID NO: 781936 - DNA, 494 bp, Homo sapiens; identical to SEQ ID NO: 613127
  misc_feature: HIJSMM301BZB5F.10.79.H02.1.454.light.4.raw

SEQ ID NO: 781937 - DNA, 508 bp, Homo sapiens
  misc_feature: HIJSMM301AT95F.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcgagggtggaggctggaggatgttgcggttttattactgcctagcagagtattcactggccggttggacgttcggtccgaaggaccgaaggtaggaaatacaaacgaactggtggctgcac

SEQ ID NO: 781938 - DNA, 496 bp, Homo sapiens
  misc_feature: HIJSMM301DX0JN.2.49.E05.1.454.light.4.raw
  modified_base (484)..(484): a, c, t, g, unknown or other
acgctcgacacacgaccggtgctcgatttagagcgactagcaacacacaaagggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccncggtcaccgtct

SEQ ID NO: 781939 - DNA, 506 bp, Homo sapiens
  misc_feature: HIJSMM301DH1B7.43.37.D04.1.454.light.4.raw
tgtgagtagtcacgaccggtgctcgatttagtagcatactgttgggtttggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgatttattactgtgcagcgtgggatgacagcctgaatgcgttgggtgttcgggcggaggggaccaaggtggacccgtctaggtcacggaccccg

SEQ ID NO: 781940 - DNA, 502 bp, Homo sapiens
  misc_feature: HIJSMM301BAB9N.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtctgcaacacggcctccctgaccatctctgggctccaggctgaggacgaggctgattattactgcagctcatactacaagcagcagcactctcgtggtattcggcggagggaccaagctgaccgtcctaggtccagcccaaggctgccccctcc

SEQ ID NO: 781941 - DNA, 486 bp, Homo sapiens
  misc_feature: HIJSMM301ED33L.40.41.D08.1.454.light.4.raw
  modified_base (436)..(436): a, c, t, g, unknown or other
  modified_base (450)..(450): a, c, t, g, unknown or other
  modified_base (454)..(454): a, c, t, g, unknown or other
tctagcgactcacgaccggtgctcgatttagtcacgcgagaaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctcgtggctccaggctgaggacgaggctgattattactgcagctcatatacaagcancagcactcccatgnggtntcggcggaggaccaagctgaccgtcctaggtc

SEQ ID NO: 781942 - DNA, 489 bp, Homo sapiens
  misc_feature: HIJSMM301EX0EN.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccaggggaccaagctggagatcaaacgaactagtggctgcaccact

SEQ ID NO: 781943 - DNA, 503 bp, Homo sapiens
  misc_feature: HIJSMM301AN5V8.48.57.F02.1.454.light.4.raw
agtatacatacacgaccggtgctcgatttagctcgatatagttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaaggctgaccgtcctaggtcagcccaaggctgccccctc

SEQ ID NO: 781944 - DNA, 477 bp, Homo sapiens
  misc_feature: HIJSMM301CK89C.52.1.A01.1.454.light.4.raw
cgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctctactttccggccctggaccatagtggatatcaaacgaactgtggctgcacc

SEQ ID NO: 781945 - DNA, 493 bp, Homo sapiens
  misc_feature: HIJSMM301EOUG2.14.33.C11.1.454.light.4.raw
cgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggtcggagggaccaagcgtgaaccgtcctaggtcagcccaaggctgccccctcggtcactctgttccctaccctcctcgtactagacg

SEQ ID NO: 781946 - DNA, 500 bp, Homo sapiens
  misc_feature: HIJSMM301AR5C2.18.59.F04.1.454.light.4.raw
tacgagtatgcacgaccggtgctcgatttagtacacacacttagggattggggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcacctcagcctccctggccatcactgggctccaggctgaggatgaggctgactattactgccagtcctatgacatgaggctgagtggttcgtatgtcttcggatctgggaccaaggtcaccgtctaagttcagaccccg

SEQ ID NO: 781947 - DNA, 480 bp, Homo sapiens
  misc_feature: HIJSMM301DF8ED.16.86.H09.1.454.light.4.raw
tgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctcgccccctcggtcactctcgttcccacctcctcgagtagtaca

SEQ ID NO: 781948 - DNA, 522 bp, Homo sapiens
  misc_feature: HIJSMM301C1VK2.3.87.H10.1.454.light.4.raw
agacgcactccacgaccggtgctcgatttagcagtactgcgttgggtttgggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggaggaccaagctgaccgtcgtaggtcacgccaaggctcgccccctcggtccactccg

SEQ ID NO: 781949 - DNA, 528 bp, Homo sapiens
  misc_feature: HIJSMM301EU3IG.16.1.A01.1.454.light.4.raw
  modified_base (356)..(356): a, c, t, g, unknown or other
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaacgacccccaaactcatcatttatgaagtctctaagcggccctcagggtatctaatcgcttctctggctccaagtctggcaacncggcctcctgaccgtctctggcctccagactgaggacgaggctgattattactgccactcatatagaagtagtactacttcctgttggttttcgggcggtagggaccaagctacgaccgtccgtacggtcacgcccaaggcctcgccccctcggtcactcctcgttcccccg

SEQ ID NO: 781950 - DNA, 383 bp, Homo sapiens
  misc_feature: HIJSMM301CHGKO.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtggatctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 781951 - DNA, 504 bp, Homo sapiens
  misc_feature: HIJSMM301BD2BG.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggacaagctgaccgtcctgcgtcacgccgaagctcgccccctcggtcacttcc

SEQ ID NO: 781952 - DNA, 523 bp, Homo sapiens
  misc_feature: HIJSMM301D4FPN.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcggcggagggaccgaggctgaccgtcctaggtcagcccaaggctcgccccctcgtcactctcgttcccaccct

SEQ ID NO: 781953 - DNA, 513 bp, Homo sapiens
  misc_feature: HIJSMM301DKVJH.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggcctcagggtttctaatcgcttctctggctccaagtctggcaacacggcctccctgacaatctctgggctccaggctgaggacgaggctgattactactgctgctcatatgcagggtcgtatctacttatgttcttcggaacgtgggaccaaggtccacccgttctaggcagcccaaggcccaacccccactgtcta

SEQ ID NO: 781954 - DNA, 495 bp, Homo sapiens
  misc_feature: HIJSMM301BZ67K.51.45.E01.1.454.light.4.raw
cgatcgtatacacgaccggtgctcgatttagtgagtcagtaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggcgtgaggatgttggggtttattactgcgtgcaaagtctgcaaactatcaccttcggccaagggacacgactggagattaaacgaactgtggctgcacca

SEQ ID NO: 781955 - DNA, 518 bp, Homo sapiens
  misc_feature: HIJSMM301BK5TU.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccgacttcgtcccgtcggaccgaaacgtaggagtatacaaacgaaactaagtaggtgtgcaccactctcgtctt

SEQ ID NO: 781956 - DNA, 498 bp, Homo sapiens
  misc_feature: HIJSMM301B54QS.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcacatcagcagactggagcctgaggtattttgcagtgtattactgtcagcagtatcataggtacaaacaccttcggccaagggacacgactacggagaattaaaggaactagtggctgcaccatctgtcttcatctccccg

SEQ ID NO: 781957 - DNA, 444 bp, Homo sapiens
  misc_feature: HIJSMM301AHMHX.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtctaggtcagcccaaggctgccccctcggtcactctgttcccaccctcctcagacgtatca

SEQ ID NO: 781958 - DNA, 493 bp, Homo sapiens
  misc_feature: HIJSMM301C02WP.16.68.G02.1.454.light.4.raw
tgtactactccacgaccggtgctcgatttagtcgatagtgaagggaaagggggagtcagacccagccaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaagcccctaaggtcctgatatatgagacttctactttagaaagtggggtcccatcaaggttcagcggcagtggatctgggacagaattcactctcactatcaccagcctgcaacctgatgtatttgctaacttattactgccaacagtatcatcatcatttagtaatttcggtggtaggaccaaggtggaggtcaaagaactagtgctgcacatctgtcttcattcc

SEQ ID NO: 781959 - DNA, 493 bp, Homo sapiens
  misc_feature: HIJSMM301DU0MI.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttacccgccat

SEQ ID NO: 781960 - DNA, 502 bp, Homo sapiens
  misc_feature: HIJSMM301DY2NP.4.27.C05.1.454.light.4.raw
  modified_base (465)..(465): a, c, t, g, unknown or other
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcgttcggcggagggaccaagctgaccgtccgngggtcagcccaaggctcgccccctcggtccacttccg

SEQ ID NO: 781961 - DNA, 532 bp, Homo sapiens
  misc_feature: HIJSMM301E22ZH.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctcgaggacgaggctgattattattgtagttcatatacaaccagtgacacttgggtgttcggcggagggaccaggctggaccgtccgtaggtcgagcccgaacggctcgccccctcggttcactctgttccctacccct

SEQ ID NO: 781962 - DNA, 522 bp, Homo sapiens
  misc_feature: HIJSMM301BUSNL.53.65.F10.1.454.light.4.raw
cgcgtatacacacgaccggtgctcgatttagctacgctctaaggggctgtctgggcctaaggaagcagcactggtggtgcctcagccatggcctggaccgttctcctcctcggcctcctctctcactgcacagactctgtgacctcctatgtgctgactcagccaacctcggtgtcagtggccccaggacagacggccagcattacctgtggggggaaaccacattggagctaaaaaatgtgcactggtaccagcagaaagccaggccaggcccctgtgctggtcgtctataatggaagcggccggccctcatggatccctgggcgattctctggctccaagtctgggaacacggccaccctaaccatcagcagggtcgaagccggggatgaggccgactattactgtcaggtgtgggataatagtaatggtgggaattgggtgttcggcggagggaccaaggctgaccgtcctaggtcagcccaaggctgccccctcggtcactctgttcccaccctcctt

SEQ ID NO: 781963 - DNA, 491 bp, Homo sapiens
  misc_feature: HIJSMM301BY3QQ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggaccaggggaccaagctggagatacaacaactgtggctgcaccatcttcg

SEQ ID NO: 781964 - DNA, 487 bp, Homo sapiens
  misc_feature: HIJSMM301DBEX9.9.77.G11.1.454.light.4.raw
tgatacgtctcacgaccggtgctcgatttagctagtcactcaagggaaagggggagtcagacccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaagcccctaaactcctgatgtattatgcgtctagattagaaagtggggtcccatcaaggttcagcggcagccaatctgggacagacttcactctcaccatcaccagtctgcagcctgatgacttcgcaagttattactgccaacagtacagaatttatccgtggacattcggccaagggaccaaggtggaaatcaaagactgtggctgcaccatcttgt

SEQ ID NO: 781965 - DNA, 486 bp, Homo sapiens; identical to SEQ ID NO: 557485
  misc_feature: HIJSMM301D3UMK.17.21.B10.1.454.light.4.raw

SEQ ID NO: 781966 - DNA, 521 bp, Homo sapiens
  misc_feature: HIJSMM301C8WMQ.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctagtcagcccaaggctgccccctcggtcactctgttcccaccctt

SEQ ID NO: 781967 - DNA, 504 bp, Homo sapiens
  misc_feature: HIJSMM301CDMUP.48.10.A10.1.454.light.4.raw
  modified_base (400)..(400): a, c, t, g, unknown or other
agtatacatacacgaccggtgctcgatttagcgtcgatctcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctaggaacagaattcactctcaccatcagcggcctgcagtctgatgattttgcaacttattctgccaanagtatcattacttattctcggaccgttcggccgtaagggaccgtagggtaggaaatacgtaaacgaacgttagtggcgtcgcgaccacgtctcgtcttctactt

SEQ ID NO: 781968 - DNA, 492 bp, Homo sapiens
  misc_feature: HIJSMM301BCATB.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtctcggaactgggaccaaggtcaccgtccg

SEQ ID NO: 781969 - DNA, 496 bp, Homo sapiens; identical to SEQ ID NO: 606479
  misc_feature: HIJSMM301E4J69.16.86.H09.1.454.light.4.raw

SEQ ID NO: 781970 - DNA, 523 bp, Homo sapiens
  misc_feature: HIJSMM301A5LUE.9.12.B01.1.454.light.4.raw
  modified_base (412)..(412): a, c, t, g, unknown or other
tgatacgtctcacgaccggtgctcgatttagtagtgtagattccgtggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcaggcgggtctgggacagatttcactctccaccatcagcagcctgcaggctgaagatgtggcagtttnttactgtcaacagtttctcgggcgttcgccaacgggaccgaaggtaggaaagtacgaaacgaaacgtacgtaggcgtcgcgaccactctcgttcgttcctatccttccccg

SEQ ID NO: 781971 - DNA, 518 bp, Homo sapiens
  misc_feature: HIJSMM301C79GW.10.27.C05.1.454.light.4.raw
catagtagtgcacgaccggtgctcgatttagacgcgatcgaaggggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgccttctttctaagggtttttcggcggagggaccgaggctcgaccgtcctaagtccagcccaaggcctcgccccctcggta

SEQ ID NO: 781972 - DNA, 513 bp, Homo sapiens
  misc_feature: HIJSMM301DDBXQ.9.53.E09.1.454.light.4.raw
  modified_base (432)..(432): a, c, t, g, unknown or other
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgtaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcanagtggtgacacctccgtggtattcggcggagggaccgaaggtgaccggtcctacggtcagcccgaaggcctcgtccccccg

SEQ ID NO: 781973 - DNA, 515 bp, Homo sapiens
  misc_feature: HIJSMM301D7KZ6.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtcggcctttctactttccggcccggggaccaaagtggaaatcaaacgactggtggctgcaccatctgtcttcatccttcccgccattc

SEQ ID NO: 781974 - DNA, 489 bp, Homo sapiens
  misc_feature: HIJSMM301AELOS.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacattattactgtcaacagtatcataatctccccacctttaccggccctgggacccgaagtagggatattcaaacgaaactgtggtctgcacc

SEQ ID NO: 781975 - DNA, 498 bp, Homo sapiens
  misc_feature: HIJSMM301A41YY.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcacgctacccgggaatccggggtccctgagcgattcagtggcagcgggtctgggacagatttcactctcaccatcagcagcctgcaggctgaagatgtggctagtttattactgtcagctaatattctactactcctcggactttcggcggacgggacgaacggtggagagtacaaaccgaactac

SEQ ID NO: 781976 - DNA, 523 bp, Homo sapiens
  misc_feature: HIJSMM301AHBFC.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggtttcggcggagggaccaggctgaccgtctaggtcagcccaaggctgccccctcggtcactctgttcccaccctt

SEQ ID NO: 781977 - DNA, 520 bp, Homo sapiens
  misc_feature: HIJSMM301E0NPQ.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagttaactaagtttcggggttttccggtcggagggaccaagctgaccgtcctaagtcagcccaaggctcgccccctcggtcactccttccg

SEQ ID NO: 781978 - DNA, 507 bp, Homo sapiens
  misc_feature: HIJSMM301DKG3S.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccggtcctgggtcacgcccaaggctcgccccctggtccta

SEQ ID NO: 781979 - DNA, 485 bp, Homo sapiens; identical to SEQ ID NO: 535501
  misc_feature: HIJSMM301EWWZG.3.10.A10.1.454.light.4.raw

SEQ ID NO: 781980 - DNA, 554 bp, Homo sapiens
  misc_feature: HIJSMM301CJ73D.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtcccaaactcattcttatgatgtcagtaatcggcccccaggggtttctgatcgcttctatggctccaagtctgcctacacggcctccctgaccatctccgggctccagcctgaggacgaggctgattattattgtagttcatatacaaccagtgacacgttgggtgttacgggcgggagggaccgaggctaggacccggtccgtaggtcacggtcccaagggcctcgcccccgtcggtccgaccttccttcggtttaccccaccccttccccg

SEQ ID NO: 781981 - DNA, 510 bp, Homo sapiens
  misc_feature: HIJSMM301APY2R.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcaggtgggtatgggacagactcactctcaccatcatcagcctggagcctgaggatgttgctagtttattactgtcaacatcgtaccgagtggccgtccgggggccacgttcggcccgtaggaccaaagtggatagtacaacgaatgtgctcgcaccatctgtcttct

SEQ ID NO: 781982 - DNA, 526 bp, Homo sapiens
  misc_feature: HIJSMM301BIH6U.41.19.B08.1.454.light.4.raw
tctatactatcacgaccggtgctcgatttagtgagtcagtaagggggctgggggtctcaggaggcagtgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgctttataattttgtcgcctggtaccaacaacaccccggcgaacgcccccagactcataatttatgatgtcactgatcggccctcgaggggtttctaatcgcttctctggctccaagtctggcaacacggcctccctgaccatctcgtgggctccaggctggaggacgaggctgattattactgcagctcatatacaagcagcagcactcctcgtggtagttcgggcgggacgggaccaaggctcggaccgttcctacggtcacgacccgaaggccgtcgccccccgttcc

SEQ ID NO: 781983 - DNA, 503 bp, Homo sapiens
  misc_feature: HIJSMM301BZ3JR.40.23.C01.1.454.light.4.raw
  modified_base (497)..(497): a, c, t, g, unknown or other
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgctagtttattactgtcagcagcgtaccaactggccgctcactttcggcggacgggaccgaaggtggagatcgaaacgaactgtggctgcaccatctgtcttnacttcc

SEQ ID NO: 781984 - DNA, 522 bp, Homo sapiens
  misc_feature: HIJSMM301EZHJ9.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattccggcggagggaccaagttgaccgtcctaagtcagcccaaggctcgcccccgtcgtcactctcgttcccccg

SEQ ID NO: 781985 - DNA, 493 bp, Homo sapiens
  misc_feature: HIJSMM301AG33H.51.28.C06.1.454.light.4.raw
cgatcgtatacacgaccggtgctcgatttagagctcacgtattgggtttggggctgggcctcaggaagcagcatcggaggtgcctcagccatggcatggatccctctcttcctcggcgtccttgcttactgcacaggattttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgtacttttactgtcaggcgtgggacagcgacactgccgtgttcgggcgggggaccaggctgaccgtcctcggtcagcccaggctcgccccctcggt

SEQ ID NO: 781986 - DNA, 515 bp, Homo sapiens
  misc_feature: HIJSMM301D6Q3L.8.42.D09.1.454.light.4.raw
ctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcagggcagcaacgagggttagttcggcggagggaccaagttgaccgtcctaggtccagcccaaggctgccccctcggtcactctgttcccgccctt

SEQ ID NO: 781987 - DNA, 500 bp, Homo sapiens
  misc_feature: HIJSMM301EC50I.40.26.C04.1.454.light.4.raw
tctagcgactcacgaccggtgctcgatttagtctagcgactttgggtttgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccatcagcagcctgcagctagaagatgttgctagtttattcctgtcagcagtacaatgactggccgtacacttttgccaggggaccaagctggaggatacaaaacgaactgtggctgcaccatctgtactt

SEQ ID NO: 781988 - DNA, 506 bp, Homo sapiens
  misc_feature: HIJSMM301C2861.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctcgccccctcggtcactctgttcccgccctcctcg

SEQ ID NO: 781989 - DNA, 524 bp, Homo sapiens
  misc_feature: HIJSMM301C2X9V.43.9.A09.1.454.light.4.raw
tgtgagtagtcacgaccggtgctcgatttagcgagacgcgcaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgacttattactgcttgctcgcctatgatgctgcgttcggggttttcggcgggacgggacctaagttggacccgttcctaaggtcagcccaaggctcgccccctggtcactctcgttcccgccctcctcta

SEQ ID NO: 781990 - DNA, 504 bp, Homo sapiens
  misc_feature: HIJSMM301AJG9O.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctggaggacgaggctgattattattgctgctcatatgcaggttagttacacttatgtcttcggaagttgggacgacggtcaccgtcctaggtcacgcccaaggcccaaccca

SEQ ID NO: 781991 - DNA, 501 bp, Homo sapiens
  misc_feature: HIJSMM301A7OXW.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtctaggtcagccaaggctgccccctggt

SEQ ID NO: 781992 - DNA, 506 bp, Homo sapiens
  misc_feature: HIJSMM301DVRA3.48.27.C05.1.454.light.4.raw
agtatacatacacgaccggtgctcgatttagacgcgatcgaagggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggtcctccctgaccgtctctgggctccaggctgaggatgaggctgattattactgcagctcatatgctaggcagcaacaatgtggtattcggcggagggacaagctgaccgtcctaggtcaagcccaaggctcgccccctcggt

SEQ ID NO: 781993 - DNA, 497 bp, Homo sapiens
  misc_feature: HIJSMM301EVN3H.40.65.F10.1.454.light.4.raw
tctagcgactcacgaccggtgctcgatttagctacgctctaaggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctcatccttcccg

SEQ ID NO: 781994 - DNA, 466 bp, Homo sapiens
  misc_feature: HIJSMM301A1NFV.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctcgttcccaccctcctcctagtctacg

SEQ ID NO: 781995 - DNA, 492 bp, Homo sapiens
  misc_feature: HIJSMM301AZ5EM.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggcgtgaagatgtcggggtttattactgcatgcagggtacagtgtggccttcgctcgcattcggcggagggaccgaaggtggagatacaaacggaa

SEQ ID NO: 781996 - DNA, 494 bp, Homo sapiens
  misc_feature: HIJSMM301C3Q51.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcggggtcccatctcggttcagtggcggtggatctaggacagaattcactctcaccatcaccaacctgcaccctgaagatgttgaagttattactgtcagacctatagtggtggcccgtctctattttcgggcggtagggaccgaaaggtgctagataccaaacgaactgtggctcgccaa

SEQ ID NO: 781997 - DNA, 499 bp, Homo sapiens
  misc_feature: HIJSMM301D7AZS.15.5.A05.1.454.light.4.raw
  modified_base (475)..(475): a, c, t, g, unknown or other
  modified_base (492)..(492): a, c, t, g, unknown or other
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggaccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtctaggtcagcccaaggctgcccctcggtcnctctgttcccgcctccncgctact

SEQ ID NO: 781998 - DNA, 492 bp, Homo sapiens
  misc_feature: HIJSMM301EJBIE.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccgaggggaaagagccacactctcctgcagggccagtcagagtgttagcagcagcttagcctggtaccagcagaacctggccaggctcccaggctcctcatctatggtgcatctacgagggccactggtactcccagccaggttcagtggcaggtgggtctgggacagagttcactctcaccatcagcagcctgcagtctgaagtatttgctagtttattactgtcagcactataataactgcctcgtactagtttggccgagggaccaagtctggagagtaccaaacgaactcgtgg

SEQ ID NO: 781999 - DNA, 488 bp, Homo sapiens
  misc_feature: HIJSMM301DU6HM.22.27.C05.1.454.light.4.raw
  modified_base (438)..(438): a, c, t, g, unknown or other
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccggggtccctgaccgattcagtggcagcgggtctgggacagatttcactctcaccatcagcagcctgcaggctgaagatgtggcagtttatactagtcagcaatattatattccncctcagcgttcggccaagggaccaaggtgaaatcaaacgactgtggactg

SEQ ID NO: 782000 - DNA, 482 bp, Homo sapiens
  misc_feature: HIJSMM301BDFAF.49.12.B01.1.454.light.4.raw
agtcgagagacacgaccggtgctcgatttagtagtgtagattccgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaactcctgatctacgatgcatccaatttggaaataggggtcccatcaaggttcagtggaagtggatctgggacgtattttactttcaccatcatcaacctgcagcctgaggatattgcaacatattactgtcaacaatatgataatctaacactcactttcggcggaggaccgacggtggagatcaaacgactagtgctgcacatctgt

SEQ ID NO: 782001 - DNA, 491 bp, Homo sapiens
  misc_feature: HIJSMM301EQ70N.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcaggggtttctaatcgcttctctggctccaagtctggcaacacggcctccctgaccatctctgggctccaggctgaggacgaggctgattattactgcagctcatatacaagcaccagcactctctatgtcttcggactggaccaggtcaccgtctaggtcagccaaga

SEQ ID NO: 782002 - DNA, 505 bp, Homo sapiens
  misc_feature: HIJSMM301AUENV.2.35.D02.1.454.light.4.raw
  modified_base (441)..(441): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttgggcggtttataactatgtctcctggtatcaacaacacccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatntacttttcggcggagggaccaagctgaccgtcctgggtcagcccaaggctgccccctcggtcta

SEQ ID NO: 782003 - DNA, 496 bp, Homo sapiens; identical to SEQ ID NO: 537925
  misc_feature: HIJSMM301A6KGR.22.14.B03.1.454.light.4.raw

SEQ ID NO: 782004 - DNA, 507 bp, Homo sapiens
  misc_feature: HIJSMM301AOG9B.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccagggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagacgcctgaggtattttgctagtttattactgtcagcagcgtatcgactggatcaccttcggccaagggacacgactaggaaattaaacgaactgtggctgcaccatctgtcttcattccttccccg

SEQ ID NO: 782005 - DNA, 481 bp, Homo sapiens
  misc_feature: HIJSMM301AZAUP.4.39.D06.1.454.light.4.raw
  modified_base (469)..(469): a, c, t, g, unknown or other
agcactgtagcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggagggtcccaccaacattcagcggcagtggatctgggacagagttcactctaaccatcagcagcctgcagcctgatgatcttaggaacttatttctgccagcaatataatagttattggacgttcgcgagggacgaaggacgaatgagacgaactgtggcgtncgaccatctgtt

SEQ ID NO: 782006 - DNA, 496 bp, Homo sapiens
  misc_feature: HIJSMM301BLF17.51.15.B04.1.454.light.4.raw
cgatcgtatacacgaccggtgctcgatttagacagtatatatccgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcaggtggagtccaggcaggaggacgaggctgacctagtttattagtcaatcaaacagacacctattggtacttatgtcttacggaactgacgacc

SEQ ID NO: 782007 - DNA, 491 bp, Homo sapiens
  misc_feature: HIJSMM301ELEGP.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatggttgggctcttattattgcatgcaagctctacaacgtcccgctcacgtttcggcggagggaccaagggtggagatacaaacgact

SEQ ID NO: 782008 - DNA, 486 bp, Homo sapiens
  misc_feature: HIJSMM301BCSX2.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaagggtggagatcaaacgaactagtcggctgcaccatctgtcttc

SEQ ID NO: 782009 - DNA, 496 bp, Homo sapiens
  misc_feature: HIJSMM301CUG8X.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctcccagactgaggatgaggctcattattactgccagtcttatgacaaacgtcagaacatttgggtgttcggcggtagggaccaagctgaccgtcctcagtcagaccccg

SEQ ID NO: 782010 - DNA, 506 bp, Homo sapiens
  misc_feature: HIJSMM301BAI9Q.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctcctgaccgtctctgggctccaagctgaggatgaggctgattattactgcagctcatatgcaggcagcagcaatgtacttttcggcggagggaccaagctgaccgtcctgggtcagcccaaggcctcgccccctcggtccta

SEQ ID NO: 782011 - DNA, 541 bp, Homo sapiens
  misc_feature: HIJSMM301ATBCH.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtcagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcggggtcgttcggtccgaacgggaaccgaacgggtacggtaaagtactaaaacgaaaccgtagtggcgttcggccaccctaactccttgttcttcgtaacttcctttccccc

SEQ ID NO: 782012 - DNA, 507 bp, Homo sapiens
  misc_feature: HIJSMM301CQHPY.51.23.C01.1.454.light.4.raw
cgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggcctccccgactcctcatttatgatgcatccaaagggtcgttggcatcccagccaggttcagtggcagtgggtctgggacagaattcactctcaccatcaccagactagagcctgaagattttgctagtttattactgtcagcagcgtaacaactggctctctttcggcggagggaccaaggtggagatacgaaacgactagtggctgcaccatctgtcttcatccttccgcctat

SEQ ID NO: 782013 - DNA, 484 bp, Homo sapiens
  misc_feature: HIJSMM301DG951.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtccatcaaggttcatcggcagtggatctgggacagatttcactctcaccatcagcagcctgcagcctgaagattttgctaactttactttgtcaacaggctcagagtttcccgctctactttcggcggacgggaccgaaggtggagatcgaaacgaactgtggctgcta

SEQ ID NO: 782014 - DNA, 518 bp, Homo sapiens
  misc_feature: HIJSMM301ELKY3.40.47.E03.1.454.light.4.raw
tctagcgactcacgaccggtgctcgatttagactcgcgcacagagagaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggccctccctgaccgtctctgggctccaggctgaggatgaggctgtttactactgcagctcatatgcaggcagcaataatttggtgttcgggcggggggaccaaggctgaccgtcctacggtcagcccaaggctgccccctcggtcactctccg

SEQ ID NO: 782015 - DNA, 509 bp, Homo sapiens
  misc_feature: HIJSMM301DJ0UO.48.26.C04.1.454.light.4.raw
  modified_base (384)..(384): a, c, t, g, unknown or other
agtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaacgcccccaaagtcatgatttatgaggtcagtaagcggccctcgaggggtccctgatcgcttctctggctccaagtctggcaacacggcctccctgaccgtctcnggctccaggctgaggatgaggctgattattactgcagctcatatgcaggcagcaacaagtgtggtagttcgggcggaggaccaagctgaccgtcctaggtcagacccgaagctcgccccctcggt

SEQ ID NO: 782016 - DNA, 519 bp, Homo sapiens
  misc_feature: HIJSMM301C2N16.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatcctcctgcactggaaccagtagtgacgttggcagttctgattctatctcctggtaccaacaacacccaggcaaagcccccaaactcataatttatgacgtcaatgttcgcccctcagggtttctcatcgcttctctggctccaaatctggcaacacggcctccctgaccatctctgggctcgagtctgaggacgaggctgattacttctgttgctcgttggcaactactgtcgtttgggtgttcggcggaggacaagttgaccgtctaggtcagcccaaggctcgcccccgttcggtcctactctcgttccccccg

SEQ ID NO: 782017 - DNA, 497 bp, Homo sapiens
  misc_feature: HIJSMM301A26VX.9.1.A01.1.454.light.4.raw
  modified_base (475)..(475): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtattactgtcagcagtatcataggtcaaacaccttcggccaagggacacgactggagattaaaggaactggtggctggcnccatctgtcttcatcttccccg

SEQ ID NO: 782018 - DNA, 505 bp, Homo sapiens
  misc_feature: HIJSMM301DK834.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgtacttggcactaacaacgcctggacttcttcggacctgggaccacggtccaccgtcctaggtcagccaaggctcgccccctcggcactctgtt

SEQ ID NO: 782019 - DNA, 509 bp, Homo sapiens
  misc_feature: HIJSMM301AE25R.14.23.C01.1.454.light.4.raw
  modified_base (472)..(472): a, c, t, g, unknown or other
cgtctagtaccacgaccggtgctcgatttagtacacgtgattagggattggggggaggaactgctcagttaggacccagacggaaccatggaagcccccagcgcagcttctcttcctcctgctactctggctcccagataccactggagaaatagtgatgacgcagtctccagccaccctgtctgtgtctccagggggaaagagccaccctctcctgcaggggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtggaaatanaaacgaactaggtaggcgtgcaccactctgtcttcta

SEQ ID NO: 782020 - DNA, 493 bp, Homo sapiens
  misc_feature: HIJSMM301DCNEX.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgctagtttattactgtcagcagcgtagcaactggcctctcactttcggcggagggaccaggtggagatcaaacgactgtgctgcaccatctgtctt

SEQ ID NO: 782021 - DNA, 483 bp, Homo sapiens
  misc_feature: HIJSMM301BD6IZ.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcgaggggtccctgaccgattctctggctccaagtctggcacctcagcctccctggtcatcgctgggctccaggctgacgatgaggctgtattattattgccagtcctatgacaacaccctgtcgttggttttggctgttcggcggcggac

SEQ ID NO: 782022 - DNA, 514 bp, Homo sapiens
  misc_feature: HIJSMM301DA8O7.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtcgcccccaccagagtgatctatgaggataacctacggccctctggggtccctcctcggtttctggctccatcgacgggtcctccactactgcctccctcaccatctctggactgaagactgaggacgaggctgactactactgtcagtcttatgataacaccgagggtggtggttcggcggagggaccaagctggccgtcctaggtcagccaaggctgccccctggcactctgttccccgccctcctcgagtagtaca

SEQ ID NO: 782023 - DNA, 480 bp, Homo sapiens
  misc_feature: HIJSMM301AJWY0.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtgagtcccatccagattcagcgtcagtgaatctgggacagagttcactctcaccatcagcagcctgcagcctgaagtattttgctaacttacttattgtacaacaggctgacacgtctcccgctcactttcgggcggacgggaccgaagggtggagatacaaacgaact

SEQ ID NO: 782024 - DNA, 486 bp, Homo sapiens; identical to SEQ ID NO: 615633
  misc_feature: HIJSMM301BJ241.46.26.C04.1.454.light.4.raw

SEQ ID NO: 782025 - DNA, 500 bp, Homo sapiens
  misc_feature: HIJSMM301ASO8O.48.14.B03.1.454.light.4.raw
agtatacatacacgaccggtgctcgatttagtgtgagtagttccgcgggcacgaccggtgctcgatttagtcacgcgagaaagggaaaggggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctccctgatcttatttgggttctaatcgggcctccggggtccctgacaggttcagtggcagtggatcaggcacagattttacactgaaaatcagcagagtggaggctgaggatgttggggtttattactgcatgcaagctctacaaactcctcggcgttcgcgtaac

SEQ ID NO: 782026 - DNA, 515 bp, Homo sapiens
  misc_feature: HIJSMM301EF7YY.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcggtggcatttgggtgttcgggcggaggggaccaaactgaccgtcctaggtcagcccaaggctcgcccctccggtcactctgttccccgccctcctcgctactaga

SEQ ID NO: 782027 - DNA, 516 bp, Homo sapiens
  misc_feature: HIJSMM301A0WYQ.41.14.B03.1.454.light.4.raw
tctatactatcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaaccagcagtgacgttggtggttataactatgtctcctggtaccaacaacacccaggcaaagcccccaaactcatgatttatgatgtcagtaatcggccctcaggggtttctaatcgcttctctggctccagtctggcaacacggcctccctgaccatctctgggctccgaggctgaggacgaggctgattattactgcagctcatatacaagcagcagcactctcgtggtattcgggcggagggaccaagctcgacccgtccgtaaggtcacggacccaaggcctcgccccccgtcc

SEQ ID NO: 782028 - DNA, 498 bp, Homo sapiens
  misc_feature: HIJSMM301ALNMS.9.1.A01.1.454.light.4.raw
tgatacgtctcacgaccggtgctcgatttagacgtctcatcaggggggagctgctcagttaggacccagagggaaccatggaaaccccagcgcagcttctcttcctcctgctactctggctcccagataccaccggagaaattgtgttgacgcagtctccgggcaccctgtctttctctccaggggagagacgccaccctctcctgcaggaccagtcagagtgttaccagcaactacttggcctggtaccagcagaaatctggccagcctcccaggcctcctcatctatggtgaatccaacagggccactggcatcccagacaggttcagtggcagtgggtctgggacagacttcactctcaccatcagcagactggagcctgaggattttgcagtgtattactgtcagcagtatcataggtacaaacaccttcggccaagggacacgactggagattaaaggaactgtggctgcaccatctgtcttcatcttccccg

SEQ ID NO: 782029 - DNA, 520 bp, Homo sapiens
  misc_feature: HIJSMM301AMZHN.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttcctcccccggacgttcgccgaacggaccgaaggtcggaaagtacgtaagacgaactacgtaggctagcaccatctcgtcttctactcttcccgtccc

SEQ ID NO: 782030 - DNA, 514 bp, Homo sapiens
  misc_feature: HIJSMM301D9KWH.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgctagttcctttaaattaggcgccactctcgtggttttcggcggtaggcaccgaagtgaccgtcctcggtcagcccaaggctgccccctggtccact

SEQ ID NO: 782031 - DNA, 492 bp, Homo sapiens
  misc_feature: HIJSMM301A1M0X.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagattcactctcaccatcagcagcctgcaggctgaagatgtggcagtttattactgtcagcaatattatagtactcctccgaggctcactttcggcggacgggaccaaggtggagatcaaacgaac

SEQ ID NO: 782032 - DNA, 494 bp, Homo sapiens
  misc_feature: HIJSMM301ESBWE.8.53.E09.1.454.light.4.raw
  modified_base (407)..(407): a, c, t, g, unknown or other
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggntgagctgattatactgccactcctatgacaacagcctgtagtatttggctggttcggcggccgggaccaagttcgaccgtcctaccg

SEQ ID NO: 782033 - DNA, 519 bp, Homo sapiens
  misc_feature: HIJSMM301CHT6I.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaacgcccccaaactcatcatttatgagaccactaagcggccctcaggggtttctgatcgcttctctgcctccaagtctggccacacggcctccctgacaatctctgggctccagactgaggacgagggtgagttattactgctgctcatacggagggactagaactttgctagttcggcggagggaccaaggttgaccgtcctaagtcagcccaaggctcgccccctcggtcactctcgtt

SEQ ID NO: 782034 - DNA, 550 bp, Homo sapiens
  misc_feature: HIJSMM301A65SK.27.23.C01.1.454.light.4.raw
  modified_base (252)..(252): a, c, t, g, unknown or other
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttntctgttggtaccgacaggacccaggcactgtccccaaactcattctttatgatgtcagtaatcggcccccaggggtttctgatcgcttctatggctccaagtctgcctacaccggcctccctgaccatctccgggctccagcctgaggacgaggctgattattattgttagttcatataacaaccagtaacacgttagggtggttcggtcgggagggaccgacggcgtgaccgtaccgtacggtacacgacccaacggctcgccccctccggtcactctcgttcccgtccctcctccg

SEQ ID NO: 782035 - DNA, 499 bp, Homo sapiens
  misc_feature: HIJSMM301EI08V.16.86.H09.1.454.light.4.raw
tgtactactccacgaccggtgctcgatttagtgctatagacttgggtttggggggctggggtctcaggaggcagcgctctcaggacatctccaccatggcctgggctctgctgctcctcaccctcctcactcaggggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcgaggggtttctaatcgcttctctggctccaagtctggcaacacggcctccctgaccatctctgggctccaggctgaggtacgagggtgattattactgcagctcatatagaagtggacagcactctcgtattcgggcggtgggaccaagctgaccgtctaggtcagcccaagg

SEQ ID NO: 782036 - DNA, 492 bp, Homo sapiens
  misc_feature: HIJSMM301CWIT4.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattacttaatacttcggtggacgttcggaccaagggaccgaaggtggatagtacagacgaa

SEQ ID NO: 782037 - DNA, 486 bp, Homo sapiens
  misc_feature: HIJSMM301ER2VS.46.35.D02.1.454.light.4.raw
  modified_base (196)..(196): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaaggctggagatcaaacgaactgtgctgcaccat

SEQ ID NO: 782038 - DNA, 498 bp, Homo sapiens
  misc_feature: HIJSMM301BE8TE.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatacaaacgaactgtggctgcacactctgtt

SEQ ID NO: 782039 - DNA, 516 bp, Homo sapiens
  misc_feature: HIJSMM301BPIYL.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctcgaccatctctgggctcgagtctgaggacgaggctgattacttctgttgctcttggcactactgtcgtttgggtgttcggcggagggacaagttgaccgtcgtacggtcagcccaaggcctgccccctcggtcactctcgttcccccg

SEQ ID NO: 782040 - DNA, 522 bp, Homo sapiens
  misc_feature: HIJSMM301B20DC.5.86.H09.1.454.light.4.raw
  modified_base (366)..(366): a, c, t, g, unknown or other
atcagacacgcacgaccggtgctcgatttagtgctatagacttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaacgcggccctcaggggtccctgatccgcttctctggctccaagtctggcaaacncggcctccctagccgtctctgggctccagactgaggatgaggctgactattactgcagctctatttgcaggcagccgtatactcttcggcggaagggaccaagctcgaccgtctacgggtcacgcccgaagggcctcggccccctcggtcctaccg

SEQ ID NO: 782041 - DNA, 507 bp, Homo sapiens
  misc_feature: HIJSMM301D8A7C.5.24.C02.1.454.light.4.raw
  modified_base (436)..(436): a, c, t, g, unknown or other
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctccatatgcaggcancagcagtccccatgtgatcttcggcgggggaccaagctgaccgtcctaggtcagcccaaggctgccccccg

SEQ ID NO: 782042 - DNA, 498 bp, Homo sapiens
  misc_feature: HIJSMM301ALSVQ.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggagggaccgagggtggagatcaaacgaactgtggctgcaccatctgtcttcattccc

SEQ ID NO: 782043 - DNA, 446 bp, Homo sapiens; identical to SEQ ID NO: 536034
  misc_feature: HIJSMM301DYV99.18.9.A09.1.454.light.4.raw

SEQ ID NO: 782044 - DNA, 504 bp, Homo sapiens
  misc_feature: HIJSMM301BLBCO.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgacgtggagattaaaggaacgtagtggctgcaccactactgttcttctattccttcccccg

SEQ ID NO: 782045 - DNA, 532 bp, Homo sapiens
  misc_feature: HIJSMM301B11RC.7.87.H10.1.454.light.4.raw
cgtgtctctacacgaccggtgctcgatttagcagtactgcgttgggtttgggggagctgctcaggttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccacggaccgaacggtaggaaggtacgtaaaccgaacgtacgtaggcgtgcgaccaactctgtcttctatactttcccgccctactctgtacg

SEQ ID NO: 782046 - DNA, 510 bp, Homo sapiens
  misc_feature: HIJSMM301CO35I.41.45.E01.1.454.light.4.raw
tctatactatcacgaccggtgctcgatttagtgagtcagtaaggaaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgtttattggtaccagcagaagccagccccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttagtcgggtgttcgggtcgggggaccgaagctgaccgtcctaggtcagcccgaaggctcgccccctcggtcacgtt

SEQ ID NO: 782047 - DNA, 528 bp, Homo sapiens
  misc_feature: HIJSMM301ATMRO.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatcctacccggcaatcccggggtccctgaccgattcagtggcagcgggtctgggacagatttcactctcaccatcagcagcctgcaggctggaagatgtggcagtttattactgtcaactagttttctcggggccgttcggccgaacgggaccgaaggtaggaaaagtacgaaaaccgaaacgtaggtcggtcgtcgcgacccattccttagttccttaccta

SEQ ID NO: 782048 - DNA, 490 bp, Homo sapiens
  misc_feature: HIJSMM301A943K.10.1.A01.1.454.light.4.raw
catagtagtgcacgaccggtgctcgatttagacgtctcatcagggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccaggccaccctcccaagctcctctccgacaggaataacatccggccctcagggatctcagagagattctctgcatccaggtcaggaagcacagcctccctgaccattacttggactccaggctgacgacgaagctgattattactgctcagcatgggacaccggcctcagtcgcgtgggttttcggcggtagggaccaagctgaccgtcctaggtcacgtaccccg

SEQ ID NO: 782049 - DNA, 515 bp, Homo sapiens
  misc_feature: HIJSMM301C168X.3.37.D04.1.454.light.4.raw
agacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccagggtgaggacgaggctgattattactgcagctctatttacaagcagcaccactcaggtcttcggaactgggactaaggtcaccgtcctaggtcgagtcccaaggcccaacccccgactcgtcact

SEQ ID NO: 782050 - DNA, 505 bp, Homo sapiens; identical to SEQ ID NO: 535503
  misc_feature: HIJSMM301E0W6V.8.28.C06.1.454.light.4.raw

SEQ ID NO: 782051 - DNA, 492 bp, Homo sapiens
  misc_feature: HIJSMM301BA6M0.16.86.H09.1.454.light.4.raw
  modified_base (469)..(469): a, c, t, g, unknown or other
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcagggtttctaatcgcttctctggctccaagtctggcaacacggcctccctgaccatctctgggctccaggctgaggacgagggtgattattactgcagctcatatagaagtggcagcactctcgtattcggcggtggaccaagcngaccgtcctaggtcacgccaagg

SEQ ID NO: 782052 - DNA, 521 bp, Homo sapiens
  misc_feature: HIJSMM301D0WRG.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggactccctgagcgattctctggctccaggtcagggacaacggtcacattggccatcagtggagtccaggcagaggacgaggctagactattattgtcaatcaacagacaccattggtacttatgtcttcggaactgcgtaaccgaaggtcgaaccgtcctcgggtcgacgccccaaacggtcccaaaccccctactcgtacaccttccg

SEQ ID NO: 782053 - DNA, 508 bp, Homo sapiens
  misc_feature: HIJSMM301EXGBQ.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtactcccagccaggttcagtggcagtgggtctgggacagagttcactctcaccatcagcagcctgcagtctgaagtattttgcggtttattactgtcagcagtataatactggccctccacggtactacttttggccgtaggggaccaagcgttggagataccaaacggaactggtggctgcactatctgtt

SEQ ID NO: 782054 - DNA, 486 bp, Homo sapiens
  misc_feature: HIJSMM301EMC35.43.61.F06.1.454.light.4.raw
tgtgagtagtcacgaccggtgctcgatttagctacgctctaagggaaagggggagagctctggagaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggtactttgcagtgtatttctgtcaacaatatggtagctcaccgtacacttttggccaggggaccaagctagaaatacaaacga

SEQ ID NO: 782055 - DNA, 501 bp, Homo sapiens
  misc_feature: HIJSMM301AZG54.3.36.D03.1.454.light.4.raw
  modified_base (473)..(473): a, c, t, g, unknown or other
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgctagtttattactgtcagcagtatggtacttcacaaaccttcggccgaaggggacacgactggagattaaagngaaccgtgtggctgcaccatctcgtctt

SEQ ID NO: 782056 - DNA, 472 bp, Homo sapiens
  misc_feature: HIJSMM301ARLU0.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggacagattttaatttcacatcagcagcctccaacgtgatgatgttgcaacatactattgtcagcaatatagatttgctcctccgagtgccacttttggcggggggacaaggtggacatcaaacgaactt

SEQ ID NO: 782057 - DNA, 486 bp, Homo sapiens
  misc_feature: HIJSMM301CP16B.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagtattttgctagtttattactgtcagcagtatcatgactggccgctcaccttcggccaagggacacgactggagattaaaccgaatgtggctgcaccat

SEQ ID NO: 782058 - DNA, 497 bp, Homo sapiens
  misc_feature: HIJSMM301AO6YQ.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtacctcctccgaggtctcacctttcggcggaagggaccgaaggtggagactcaaacgaa

SEQ ID NO: 782059 - DNA, 514 bp, Homo sapiens
  misc_feature: HIJSMM301ATVUI.51.87.H10.1.454.light.4.raw
cgatcgtatacacgaccggtgctcgatttagcagtactgcgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggaggaccaaactcgaccgtccgtaggtcacgcccaaggcctcgccccctcggtcta

SEQ ID NO: 782060 - DNA, 504 bp, Homo sapiens
  misc_feature: HIJSMM301DHHSZ.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagcctttcactctcaccatcagcagcctggagcccgaagattttgcggtttattactgtcagcagcgtgccgactggcccctcacgttcggcggagggaccaaggtggacatcaaacgaactgtggctgcaccatctgtcttcatctcccgc

SEQ ID NO: 782061 - DNA, 447 bp, Homo sapiens; identical to SEQ ID NO: 535020
  misc_feature: HIJSMM301CK3ZB.18.9.A09.1.454.light.4.raw

SEQ ID NO: 782062 - DNA, 534 bp, Homo sapiens
  misc_feature: HIJSMM301A0F9U.9.12.B01.1.454.light.4.raw
  modified_base (510)..(510): a, c, t, g, unknown or other
tgatacgtctcacgaccggtgctcgatttagtagtgtagattccgcgggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagttttatactgtcaactagtttttctcggggtcgttcggtaccgaacgggaaccgaacgggtaggaaagtaacgaaacgaaacctaggtaggtcgtggcaccgtntactgttcttctactccttccccg

SEQ ID NO: 782063 - DNA, 490 bp, Homo sapiens
  misc_feature: HIJSMM301BKJPL.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgctagttttattactgtcagcattacaataactcggcctcggctcactttcggcggagggaccaaggtggagatcaaacgaacgtgtggctgcaccat

SEQ ID NO: 782064 - DNA, 479 bp, Homo sapiens
  misc_feature: HIJSMM301ESE7P.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatcgtgggacagtattttactttcaccatcagcagcctgcagcctgaagatattgcaacatattactgtcagcagtatgataatctcccgatccaccttcggccaagggacacgacgtggagattaaacgaactgtggctgcacc

SEQ ID NO: 782065 - DNA, 487 bp, Homo sapiens
  misc_feature: HIJSMM301CV5H0.48.34.D01.1.454.light.4.raw
agtatacatacacgaccggtgctcgatttagatcgtctgtgttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcgggtcgggagggaccgaagctgtaccggtcctaaggtcagaccccg

SEQ ID NO: 782066 - DNA, 498 bp, Homo sapiens
  misc_feature: HIJSMM301E16OW.43.39.D06.1.454.light.4.raw
tgtgagtagtcacgaccggtgctcgatttagtgacatctcgcaggtttctttgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcaggtgggtctgggacagacttcactctcaccgttcagcagactggaccctgaagattttgcagtgtattactgtcagcagtatggtagctcaccgatcaccttcggcaaggacacgactggagattaaccgaactgtggctgcacatctgtctt

SEQ ID NO: 782067 - DNA, 447 bp, Homo sapiens; identical to SEQ ID NO: 712104
  misc_feature: HIJSMM301D1CK2.47.85.H08.1.454.light.4.raw

SEQ ID NO: 782068 - DNA, 497 bp, Homo sapiens
  misc_feature: HIJSMM301A2RMN.53.11.A11.1.454.light.4.raw
cgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctcgccccctcggtcactctcg

SEQ ID NO: 782069 - DNA, 490 bp, Homo sapiens
  misc_feature: HIJSMM301CZMKW.48.57.F02.1.454.light.4.raw
agtatacatacacgaccggtgctcgatttagctcgatatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttttggatcagcagaagtcaggccaggccccaagactgctcatgtatagagacagtgagaggtcctcagggatccctgagcgattctctggctccagctctgggacacactcactctgactatcagtgaagtccggcagaagacgaggctgactactattgtcagtcaggagacaatactcgcacgcaagtactgttcggcggagggaccaagctgacagtcctaggtcagcccaaggctcgcccccg

SEQ ID NO: 782070 - DNA, 484 bp, Homo sapiens
  misc_feature: HIJSMM301BS0UN.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgagggcgaggctgatttattattgctgctcatatgcaggtagttacattatgtcttcggaattgggacgacggtcaccgtcctaggtcag

SEQ ID NO: 782071 - DNA, 477 bp, Homo sapiens
  misc_feature: HIJSMM301ELPZ6.11.76.G10.1.454.light.4.raw
  modified_base (396)..(396): a, c, t, g, unknown or other
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccacatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcagctgaagangtggcagcttattattgtcagcaatattatacttctcttccgatcacttttggccagggaccaggctggagatcagacgaa

SEQ ID NO: 782072 - DNA, 481 bp, Homo sapiens
  misc_feature: HIJSMM301BQTY4.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcactcagcctccctggtcatcgctgggctccaggctgacgatgaggctgattattattgccagtcctatgacaacaccctgcgttggttttggctgttcggcggcgggacc

SEQ ID NO: 782073 - DNA, 498 bp, Homo sapiens
  misc_feature: HIJSMM301BXGWZ.27.78.H01.1.454.light.4.raw
  modified_base (383)..(383): a, c, t, g, unknown or other
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatcgtgggacacatttcaccctcaccatcaatagcctggaanctgaagatgctgctaacttattactgtcaatcagagtactactttacctcaagtgatcaccttcggccaagggacacgactggagattaaacgaactgtggctgcaccatctgtt

SEQ ID NO: 782074 - DNA, 512 bp, Homo sapiens
  misc_feature: HIJSMM301CCKC3.12.71.G05.1.454.light.4.raw
  modified_base (441)..(441): a, c, t, g, unknown or other
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggcctcaggagtttctgatcgcttctctggctcagctggcgaccggctcctgacaatatctgggctccaggctgaggacgaggctcattactactgctgctcatatggaggttatagcacttgggtnttcggcggcgggaccaaagtcgacgtcctaagtcagccaaggctgcccctcggtcactctgttcccacctt

SEQ ID NO: 782075 - DNA, 498 bp, Homo sapiens
  misc_feature: HIJSMM301CIIO5.18.59.F04.1.454.light.4.raw
  modified_base (454)..(454): a, c, t, g, unknown or other
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtnttcggactgggaccaaggtccaccgtcctaggtcagcccaagga

SEQ ID NO: 782076 - DNA, 519 bp, Homo sapiens
  misc_feature: HIJSMM301DI74M.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagtttcatatacaaccagtgacacttgggtgttcggcggagggaccaggctgaccgtcctaggtcagcccaaggctgccccctcggtcactctgtcccacct

SEQ ID NO: 782077 - DNA, 452 bp, Homo sapiens
  misc_feature: HIJSMM301EWTF0.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcacgcctccctggccatcactgggctccaggctgaggatgaggctgactattactgccagtcctatgacatgaggctgagtggttcgtatgtcttcggatctgggaccaaggtcaccgtcctaagtcagcccaacggccaacccctctgtcactctcgttccccgccctcctccatacctcgta

SEQ ID NO: 782078 - DNA, 470 bp, Homo sapiens
  misc_feature: HIJSMM301EGA3X.7.81.H04.1.454.light.4.raw
  modified_base (467)..(467): a, c, t, g, unknown or other
cgtgtctctacacgaccggtgctcgatttagtagtgtagattcgcgggggaggtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaactgatgatttgctaacttactactgtcaacagagttccactccccaatcactttcggcctcggactgaagtgcatatgaagagaactgnggt

SEQ ID NO: 782079 - DNA, 519 bp, Homo sapiens
  misc_feature: HIJSMM301ATJNP.7.34.D01.1.454.light.4.raw
cgtgtctctacacgaccggtgctcgatttagatcgtctgtgttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacgaggggacagctattagtttggggtgttcgggacggagggaccaagctcgaccgtctgcgtcagccaaggctccgcccctggtcactcg

SEQ ID NO: 782080 - DNA, 519 bp, Homo sapiens
  misc_feature: HIJSMM301A0KC3.40.87.H10.1.454.light.4.raw
tctagcgactcacgaccggtgctcgatttagcagtactgcgttgggtttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaaccggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtcctaggtcagcccaaggctcgccccctcggtcactc

SEQ ID NO: 782081 - DNA, 504 bp, Homo sapiens
  misc_feature: HIJSMM301D29QO.47.60.F05.1.454.light.4.raw
  modified_base (432)..(432): a, c, t, g, unknown or other
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagtattttgctagtttattactgtcagcagtatcatgactcggccnctcaccttcggaccgaaggggacctacggacctggaggaattaaacgaacctggtggctgcaccatcttacg

SEQ ID NO: 782082 - DNA, 519 bp, Homo sapiens
  misc_feature: HIJSMM301D5SD6.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactgggccgtttcacgtttcggtcgggagggaccgaaacgggtggacccgtcaaacgaaactagtggctgcaccatctgtcttctatcttcccgcc

SEQ ID NO: 782083 - DNA, 490 bp, Homo sapiens
  misc_feature: HIJSMM301EQ42E.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtgggtcccgtcaaggttcagtggcagtggatctgggacagatttcactctcaccgtcagcagtctgcaacctgaagattttgctaacttactactgtcaacagagttacacgtacccccctcacgtttcggcggaggaccgaaggcgagatcagacgaactgtggctgcaccatctgtcttcta

SEQ ID NO: 782084 - DNA, 481 bp, Homo sapiens; identical to SEQ ID NO: 779795
  misc_feature: HIJSMM301CG97G.16.86.H09.1.454.light.4.raw

SEQ ID NO: 782085 - DNA, 521 bp, Homo sapiens
  misc_feature: HIJSMM301CGGCT.40.81.H04.1.454.light.4.raw
tctagcgactcacgaccggtgctcgatttagtagtgtagattcgcgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaactaagttggtcttcgggcggagggaccaaggctcgaccgtcctaggtcacgacccgaaggcctcggtcccccctcggtcctacc

SEQ ID NO: 782086 - DNA, 500 bp, Homo sapiens
  misc_feature: HIJSMM301BJOKP.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgacgcgattctctggctccaggtcagggacaacggtcacattggccatcaagtggagtccaggcaggaggacgaggctgactattattgtcaatcaacagacaccattggtacttatgtcttcggaactcgcgaccaaggtcaccgtcctggtcagcccaaggccaacccactgtcacttc

SEQ ID NO: 782087 - DNA, 498 bp, Homo sapiens
  misc_feature: HIJSMM301A9EZ9.47.77.G11.1.454.light.4.raw
agctcacgtacacgaccggtgctcgatttagctagtcactcaaggggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaacgcccctaacctcctgatctatgctgcatccagtttgcatagtggggtcccatctaggttcagtggcagtggatctgggacagatttcactctcaccatcagcagtctgcaacctgaagtattttgctaacttactactgtacaacagagttaccggtaccccgtactacttttggccaggggaccaaacgtggacataccaaagaactgtggctgcaccatcttcg

SEQ ID NO: 782088 - DNA, 511 bp, Homo sapiens
  misc_feature: HIJSMM301EDRR1.15.59.F04.1.454.light.4.raw
tctacgtagccacgaccggtgctcgatttagtacacacacttagggattggggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgttattattgtgtcctatatatgggtgctggctatttcggtcttcggcggagggaccaagctgaccgtcctagggtcagcccgaaggcctgccccctcggt

SEQ ID NO: 782089 - DNA, 482 bp, Homo sapiens
  misc_feature: HIJSMM301D77Z4.13.34.D01.1.454.light.4.raw
tcacgtactacacgaccggtgctcgatttagatcgtctgtgttgggtttggggagagctcgtggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggcctcctcatttatggtgcatccactagggccactggtgtcccagtcaggttcagcggcagtgggtctggggacagacttcactctcaccatcagcagctgcagtctgaagattttgctagtctattactgtcagcagtatagttactggagaaccttcggccaagggacacgactggagattaaaggaa

SEQ ID NO: 782090 - DNA, 519 bp, Homo sapiens
  misc_feature: HIJSMM301BABDN.19.78.H01.1.454.light.4.raw
tactctcgtgcacgaccggtgctcgatttagtgtgagtagttttggggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctggaggacgaggctgattactactgctgctcatatgcaggtccgttatcctctttatgttcttcgggaactgggaaccaaggtccacccgtcctaggtccagcccaaggacccaaccccactgtcta

SEQ ID NO: 782091 - DNA, 495 bp, Homo sapiens
  misc_feature: HIJSMM301DZOZT.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattaactgccaacagtataagagttatccgtggacgttcggccaggaccagggtggaatacaaacgaactagtggtctgcaccatctgtcttcat

SEQ ID NO: 782092 - DNA, 506 bp, Homo sapiens
  misc_feature: HIJSMM301A2E85.11.67.G01.1.454.light.4.raw
  modified_base (181)..(181): a, c, t, g, unknown or other
cgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctcagcgtctgggacccccgggnagagaatcaccatctcttgtactggaagcagctccaatatcggaagtaacgatgtcaaattggtatcaacatcctccccggtacggcccccaaactcctcatctataggaatagccagcggccctcaggggtccctggccgattctctggctcgaagtctggcacctcagcctccctggcctgcagtgggctccagtctgaggatgaggctgacttattattgtgcagcgtgggatgacggtctgagtgctgtggtcttcggcggagggaccaagctgaccgtcctgggtcagcccaaggctcgccccctcggtccactcttccg

SEQ ID NO: 782093 - DNA, 517 bp, Homo sapiens
  misc_feature: HIJSMM301C6LQX.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaacatccggccctcagggatcccagaccgattctctggctccaactcaggaaacacagcttccttgaccatcactggggctcaggcggaagatgaggctgactattactgtaacttcccgggacacgcagtgctaaccccaattatgtcttcggaactgggaccaaggtcaccgtctaggtcagccaggcccaaccctac

SEQ ID NO: 782094 - DNA, 491 bp, Homo sapiens
  misc_feature: HIJSMM301D5T12.7.59.F04.1.454.light.4.raw
  modified_base (459)..(459): a, c, t, g, unknown or other
cgtgtctctacacgaccggtgctcgatttagtacacacacttagggattgggggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactgganattaaacgaactgtggctgcaccatctgtctt

SEQ ID NO: 782095 - DNA, 498 bp, Homo sapiens
  misc_feature: HIJSMM301CP0K0.19.71.G05.1.454.light.4.raw
  modified_base (376)..(376): a, c, t, g, unknown or other
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctnaccatcagcagcctgcaggctgaagatgtggcagtttattattgtcaacaatattattatacttcgtggacgttcggcctaagggaccgaacggtggataattcagacgaactagtggctgt

SEQ ID NO: 782096 - DNA, 488 bp, Homo sapiens
  misc_feature: HIJSMM301DX9MB.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacacttgaaaatcaggccgggtggaggctgaggacgttggaatttattactgtatgcaaggtatagagcttacctccgacgttcggcaaggaccaggtggaactacaaacgaa

SEQ ID NO: 782097 - DNA, 497 bp, Homo sapiens
  misc_feature: HIJSMM301AVXRJ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgtaacttactactgtcaacagagttacacgtacccccctctactttcggcggagggaccaaggcggagatcagacgaactgtggctgcaccatctgttcttcattccc

SEQ ID NO: 782098 - DNA, 521 bp, Homo sapiens
  misc_feature: HIJSMM301B4MPT.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggcttgattaattactgctgctcatattacgaggggacagcatttatttgggttgttcggcgggagggaccaagctgaccgtcctgcgtcacgcccaaggcctgccccctcggtcactt

SEQ ID NO: 782099 - DNA, 505 bp, Homo sapiens
  misc_feature: HIJSMM301BWGIR.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatagaaaactacttagcttggtaccagcagagaccaggacagcctcctaggctgctcatttactgggcatctacccgggaatcccggggtccctgaccgattcagtggcagcgggtctggggacagatttcactctcaccatcagcagcctgcaggctgaagatgtggctagtttattattgtcaacaatattattatacttcgtggacgttcggccaaggaccgaaggtggatatctagaccgaactgtaggcgtgctacc

SEQ ID NO: 782100 - DNA, 509 bp, Homo sapiens
  misc_feature: HIJSMM301BZVWF.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcgaaacgaactagtggctgcaccatctgtcttcattcccg

SEQ ID NO: 782101 - DNA, 494 bp, Homo sapiens
  misc_feature: HIJSMM301A4WRK.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcacatcgtacgagtggcctccgggggccacttcggccctgggaccaaacgtggagatcaaacgaacgtgtggc

SEQ ID NO: 782102 - DNA, 500 bp, Homo sapiens
  misc_feature: HIJSMM301BE3ST.49.41.D08.1.454.light.4.raw
agtcgagagacacgaccggtgctcgatttagtcacgcgagaaagggaaaggggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgacttattattgtcaatcaacagacaccattggtacttatgtcttcggaactgcgaccaaggtcaccgtcctgggtcagcccaaggccaacccactgtcactctcg

SEQ ID NO: 782103 - DNA, 484 bp, Homo sapiens
  misc_feature: HIJSMM301BA7C0.4.14.B03.1.454.light.4.raw
agcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtggggtcccatcaagattcagcggcagtggatttgggaacagaattcactctcaccatcagcagcctgcagcctggtgtattttgctaacttattactgccaacagtataatagttattctctcactttcggtcggagggaccaaggtcggagagcaaacgaactgtggtcg

SEQ ID NO: 782104 - DNA, 456 bp, Homo sapiens
  misc_feature: HIJSMM301D5NQI.19.86.H09.1.454.light.4.raw
tactctcgtgcacgaccggtgctcgatttagtgctatagacttgggtttggggggccgttcctgggcccagtctgtgctgactcaggcaccctcagcgtctgggacccccgggaagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacgggtccggttttcggcggagggaccaagctgaccgtcctaagtcagcgcaaggctgccccctcggtcactctcgttcccaccctcctccacgagagta

SEQ ID NO: 782105 - DNA, 490 bp, Homo sapiens
  misc_feature: HIJSMM301EKRI0.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagtattttgctaatttattactgtcagcagtataataactggtggacgttcggccaagggaccaaggtagaaatcaaacgaactgtggctgcaccatctgtt

SEQ ID NO: 782106 - DNA, 511 bp, Homo sapiens
  misc_feature: HIJSMM301CV54O.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagccaaggctcgccccctccggtcactctcgttcccg

SEQ ID NO: 782107 - DNA, 523 bp, Homo sapiens
  misc_feature: HIJSMM301CVF01.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttatacctgtcaactaatttccgttatactccgcgaccgttcggccggggtaccgacccgtgaaagtacaaacgaaacctggttcggctacgctaccactctgttctt

SEQ ID NO: 782108 - DNA, 510 bp, Homo sapiens
  misc_feature: HIJSMM301BXPG4.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggcctcagggtttctaatcgcttctctggctcaagtctggcaacacggcctcctgaccatctctgggctccaggctgaggacgaggctgattattactgcagctcatatacaagcagcagcactcaagtcttacggaactgggaccaaggtcaccgtcctaggtcacgcccgaacggcccaaccccactcgtacta

SEQ ID NO: 782109 - DNA, 505 bp, Homo sapiens
  misc_feature: HIJSMM301ENBPE.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctctaagtctggcaacacggcctccctgaccatctctgggctccgaggctgatgacgaggctgattattactgcaggtcatatacaatcagcaacacttatgtcttcgggactgggaccaagatcaccgtcctaggtcagcccaaggaccaaccccatcgcta

SEQ ID NO: 782110 - DNA, 517 bp, Homo sapiens
  misc_feature: HIJSMM301E3PNW.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcgggcggagggacccaaggctggaccgtccgtgggttccagcccgaaggcctgtccccccgtcggtccta

SEQ ID NO: 782111 - DNA, 493 bp, Homo sapiens
  misc_feature: HIJSMM301BRF86.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgctaacttattactgccaacagtataatggttatgaatcacttttggacctaagggaccaagctggagatacaaacgaactggtgctgcaccta

SEQ ID NO: 782112 - DNA, 529 bp, Homo sapiens
  misc_feature: HIJSMM301CQ2IT.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggaccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagtttcatatacaaccagtcgacacttgggtgttcgggcggagggaccgaggctcgaccgtcctaggtcagcccaaggctcgccccctcggtcactctcgttccccgccct

SEQ ID NO: 782113 - DNA, 507 bp, Homo sapiens; identical to SEQ ID NO: 731773
  misc_feature: HIJSMM301DOMSN.3.79.H02.1.454.light.4.raw

SEQ ID NO: 782114 - DNA, 498 bp, Homo sapiens
  misc_feature: HIJSMM301B5AOE.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcgggcggtgggaccaagctgaccgtcctaggtcagcccaaggccg

SEQ ID NO: 782115 - DNA, 504 bp, Homo sapiens
  misc_feature: HIJSMM301C4KXZ.3.37.D04.1.454.light.4.raw
  modified_base (372)..(372): a, c, t, g, unknown or other
agacgcactccacgaccggtgctcgatttagtagcatactgttgggtttgggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgaggtcacaaagcggccctcaggggtccctgatcgcttctctgcctcaagtctggcaacacggcctcccngaccgtctctgggctccagcctgaggatggaggctgattattactgcagctcatatgcaggcatcaacactgttttcggcggagggaccgaagctgaccgtcctaggtcagcccaaggctcgccccctcggt

SEQ ID NO: 782116 - DNA, 484 bp, Homo sapiens; identical to SEQ ID NO: 551212
  misc_feature: HIJSMM301BR31A.3.10.A10.1.454.light.4.raw

SEQ ID NO: 782117 - DNA, 492 bp, Homo sapiens
  misc_feature: HIJSMM301CX602.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattccacattcggccctgggaccaaagtggagatcaaacgaactggt

SEQ ID NO: 782118 - DNA, 491 bp, Homo sapiens
  misc_feature: HIJSMM301C8AFG.40.57.F02.1.454.light.4.raw
tctagcgactcacgaccggtgctcgatttagctcgatatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgtctcttatgcaggctagttcgctctcgaagtgttcggcggagggaccgagctgaccgtcctacgtcagccc

SEQ ID NO: 782119 - DNA, 507 bp, Homo sapiens
  misc_feature: HIJSMM301AEUZ9.48.16.B05.1.454.light.4.raw
agtatacatacacgaccggtgctcgatttagagctcacgtaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagccccccaactcataatttatgcggcctctcagccggcccccaggggtttccagtcgcttctctgcctccaagtctggcaacacggcctccttgacaatctctggcctccagcctgaggacgaggctgacttattactgctgctcatatacaactatgatgtcttttttgttcggcggagggaccaactgaccgtcctcggtcggcccaggctcgccccctcggtcactctcg

SEQ ID NO: 782120 - DNA, 516 bp, Homo sapiens
  misc_feature: HIJSMM301EE0QA.14.85.H08.1.454.light.4.raw
cgtctagtaccacgaccggtgctcgatttagtatcactcagtcgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcggggtccctgatcgcttctctggctccaagtctggcaacacggcctccctgaccgtctcgtgggctccaggctgacgatgaggctgattattactgcagctcacatgcagtcagtaactaatttcgggggttttcggcggagggaccaagctgaccgtcctaagtcagcccaaggctcgccccctcggtcactctccg

SEQ ID NO: 782121 - DNA, 480 bp, Homo sapiens
  misc_feature: HIJSMM301AWQ1F.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagtcactctgaccatcagcgggacccaggctatggatgaggctgactattactgtcaggcgtgggacatcagcagtgaggtggttttcggcggagggaccgaagctgaccgtcctaagtcagacccg

SEQ ID NO: 782122 - DNA, 494 bp, Homo sapiens
  misc_feature: HIJSMM301ENIC5.4.33.C11.1.454.light.4.raw
  modified_base (481)..(481): a, c, t, g, unknown or other
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgttatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcacccatcagcagcctgcaggctgaagatgtggctagtttattactgtcagcaatattctactactcctcggactttcggcggagggaccgaagtaggagancaaacgaactagt

SEQ ID NO: 782123 - DNA, 483 bp, Homo sapiens
  misc_feature: HIJSMM301AZY3N.13.34.D01.1.454.light.4.raw
tcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctctatttatggtgcatccactagggccactggtgtcccagtcaggttcagcggcagtgggtctgggacagacttcactctcaccatcagcagcctgcagtctgaagtattttgcagtctattactgtcagcagtattagttactaggagaaccttcggccaagggacacgactggagattaaaggaa

SEQ ID NO: 782124 - DNA, 502 bp, Homo sapiens
  misc_feature: HIJSMM301EJRCD.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggagctgaggatgttgcggtttattactgcctgcagagtattcactggccgtggaccgttcggccaagggaccaaggtggaaatcaaacgactagtggctgcaccatcg

SEQ ID NO: 782125 - DNA, 497 bp, Homo sapiens
  misc_feature: HIJSMM301DZSTO.22.5.A05.1.454.light.4.raw
acatacgcgtcacgaccggtgctcgatttagatagatagacagggggagggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacaggacttcactctcaccatcagcagcctagagcctgaagattttgcagtttattactgtcagcagcgtagcaactccctcacgttcggcggagggaccaaggtggagatacaaacgaactgtggctgcaccatctgtcttcattctcccgc

SEQ ID NO: 782126 - DNA, 490 bp, Homo sapiens
  misc_feature: HIJSMM301C31LJ.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggtattttgcaacttattactgtctacaagattacacttaccctgggacgttcggccgaacgggaccgaacggtaggaaatacaaacgaactagtggctggcaccta

SEQ ID NO: 782127 - DNA, 520 bp, Homo sapiens; identical to SEQ ID NO: 535686
  misc_feature: HIJSMM301A2R9N.41.19.B08.1.454.light.4.raw

SEQ ID NO: 782128 - DNA, 501 bp, Homo sapiens
  misc_feature: HIJSMM301ECMI4.11.67.G01.1.454.light.4.raw
  modified_base (204)..(204): a, c, t, g, unknown or other
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggnagagaatcaccatctcttgtactggaagcagctccaatatcggaagtaacgatgtcaattggtatcaacatctccccggtacggcccccaaactcctcatctataggaatagccagcggccctcgaggggtccctggccgattctctggctcgaagtctggcacctcagcctcctggcctgcagtgggctccagtctgaggatgagctgactattattgtgcagcgtgggatgacggtctgagtgctgtggttcttcggcggtagggaccaaggcctaggaccgtccgtgggtcacg

SEQ ID NO: 782129 - DNA, 498 bp, Homo sapiens
  misc_feature: HIJSMM301AQ62A.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagctaccaactggccgctcactttcggcggagggaccaaggtggagatcaaacgaactgtggctgcacatctgtcttcacttcc

SEQ ID NO: 782130 - DNA, 585 bp, Homo sapiens
  misc_feature: HIJSMM301AHF8N.13.33.C11.1.454.light.4.raw
tcacgtactacacgaccggtgctcgatttagagtgagctcgttggggttttgggggggggtctcaggaggcagcgctctcggggcgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccagtgacattggtgattataattatgtctcctggtaccaacagtgcccaggcaaacgcccccaaactcataattttttactgtcagtcatcggccctcaggggtttctaatcgtttctctggctccaagtctggcaacacggcctccctgaccatctctgggctccaggctgaagacgaggctgattattactgcagctcatatacaagcggcagcttctcttttatcttcgttcgggagggttcgggaaccgtaaagggtccctaacccggttcccttaaacggtccgtaacggacccccgaaaacgggcccccaaaacccccccgtaaccttccggttacctaaccgtttccccg

SEQ ID NO: 782131 - DNA, 496 bp, Homo sapiens
  misc_feature: HIJSMM301CU9ZR.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagtttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagaattaaacgaactgt

SEQ ID NO: 782132 - DNA, 523 bp, Homo sapiens
  misc_feature: HIJSMM301BFCJK.48.17.B06.1.454.light.4.raw
agtatacatacacgaccggtgctcgatttagtcgatagtgaagggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaacgcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgtatttcggcggagggaccaagctgaccgtcctacgtcacgcccaaggctcgccccctcggtcactctcgttcccgccctt

SEQ ID NO: 782133 - DNA, 514 bp, Homo sapiens
  misc_feature: HIJSMM301EGWRF.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctcaagtctgcctacacggcctccctgaccatctccgggctccagcctgaggacgaggctgattattattgtagttcatatacaaccagtgacacttgggtgttcggcggagggaccaggctgaccgtcctaggtcagccagctgcccctgtcactctcgtcccacct

SEQ ID NO: 782134 - DNA, 498 bp, Homo sapiens
  misc_feature: HIJSMM301BJMPT.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggtagggaccaagctgaccgtcctaggtcagcccaaggctgccccctcggtcactctcgttcccgccctcctcgagtgcgtct

SEQ ID NO: 782135 - DNA, 517 bp, Homo sapiens
  misc_feature: HIJSMM301ANKCA.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtggttcgggcgggagggaccaagctgaccgtcctgcgtcagcccaaggctcgccccctcggtcactcg

SEQ ID NO: 782136 - DNA, 498 bp, Homo sapiens
  misc_feature: HIJSMM301CY75H.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctggggacttttgggcctaggggaccaaggctggagatcaaacgactgtggctgcaccatctgtcttcta

SEQ ID NO: 782137 - DNA, 498 bp, Homo sapiens; identical to SEQ ID NO: 535914
  misc_feature: HIJSMM301D5JGR.18.59.F04.1.454.light.4.raw

SEQ ID NO: 782138 - DNA, 517 bp, Homo sapiens
  misc_feature: HIJSMM301DP7B9.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgtcctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctgctccaagtccggcgacacggcctccctgaccatctccggcctccaggcggaggacgagggtgattatttctgcagctcatttacaaccagccacaccttgctcttcggaactgggaccacggtcatcgtcctagtccagcccaagcccaacccactgtcactctgttcccgcctcct

SEQ ID NO: 782139 - DNA, 500 bp, Homo sapiens
  misc_feature: HIJSMM301AD583.41.53.E09.1.454.light.4.raw
tctatactatcacgaccggtgctcgatttagagagagtgtgttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgacttattactgcagctcatatacaagcagcagcactctcgtggtattcggcggagggaccaagctgaccgtctaggtcagcccaaggctccg

SEQ ID NO: 782140 - DNA, 493 bp, Homo sapiens
  misc_feature: HIJSMM301DV3RA.49.8.A08.1.454.light.4.raw
agtcgagagacacgaccggtgctcgatttagcatactctacagggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatcaccatcacttggccgggcgagtcaggacattagcatgtatctgaattggtatcagcaaaaccagggacagcccctaagctcctgatcctcgatgcatccactttggaaacaggggtcccatcaaggttcagtggaagtggctctgggacagtattttactttcaccatcagcagactgcagcctgaagatattgcaacattattactgtcaacagtatgatagtcctcccgctcacgtttcgggcgggacgggtaccgaagggtggacgtaataccgaaaacgtaaacgttggtaggctt

SEQ ID NO: 782141 - DNA, 501 bp, Homo sapiens
  misc_feature: HIJSMM301EXMKV.48.57.F02.1.454.light.4.raw
  modified_base (423)..(423): a, c, t, g, unknown or other
  modified_base (447)..(447): a, c, t, g, unknown or other
agtatacatacacgaccggtgctcgatttagctcgatatagttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcntatgcaggtggtactacttgggtnttcggcagagggaccaaggctgaccgtcctaggtcagcccaaggctgccccccg

SEQ ID NO: 782142 - DNA, 478 bp, Homo sapiens
  misc_feature: HIJSMM301DRW35.46.26.C04.1.454.light.4.raw
  modified_base (409)..(409): a, c, t, g, unknown or other
  modified_base (430)..(430): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttggtctaatcgggcctccggggtccctgacaggttcagtggcagtggatcaggcacagattttacactgaaaatcagcagagtggagctgaggatgttgggntctattattgcatgcaagctntacaagtcccgctcactttcggcggagggaccaggtgagatacaacga

SEQ ID NO: 782143 - DNA, 520 bp, Homo sapiens
  misc_feature: HIJSMM301AD20G.48.68.G02.1.454.light.4.raw
agtatacatacacgaccggtgctcgatttagtcgatagtgaagggaaggggctgggcctaaggaagcagcactggtggtgcctcagccatggcctggaccgttctcctcctcggcctcctctctcactgcacaggctctgtgacctcctatgttctgactcagccaccctcggtgtcagtggcccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggtagggaccaagctgaccgtcctaggtcagcccaaggcctgccccctcggtcactctgttcccacct

SEQ ID NO: 782144 - DNA, 506 bp, Homo sapiens
  misc_feature: HIJSMM301EGZYO.51.46.E02.1.454.light.4.raw
cgatcgtatacacgaccggtgctcgatttagactcatctacaggggaaagggggatcaggactcctcagttcaccctctcacaatgaggctccctgctcagctcctggggctgctaatgctctgggtcccaggatgcagtggggctgttgtgatgactcagtctccactctccctgcccgtcacccttggacagccggcctccatctcctgcaggtctagtcaaggcctcgtttatagtgatggagacacctacttgagttggtttcaccagaggccaggccaatctccaaggcgcctaatttataaggtttctaaccgggactctggggtcccagacaaattcagcggcagtgggtcaggcactgatttcacactgaaaatcagcagggtggaggctgaggatgttgggatttactactgtatgcaaggtacacactggcctctcactttcggcggagggaccaaggtggagatagaacgaaactgtggctgcaccatctgtctt

SEQ ID NO: 782145 - DNA, 512 bp, Homo sapiens
  misc_feature: HIJSMM301B17GC.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgctggtgtgcagcctgaggacgaggctgactattactgcctactctactttggtggtgctgtgctattcggcggagggaccaagctgaccgtcttaagtcacgcccaaggctcgccccctcggtcactctcgttcccta

SEQ ID NO: 782146 - DNA, 491 bp, Homo sapiens
  misc_feature: HIJSMM301EDFJN.48.56.F01.1.454.light.4.raw
agtatacatacacgaccggtgctcgatttagcagacgtctgaacacacaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatttcctgcactgggaccagctccaacatcggcgtaggttatgatgtacactggtaccagcaacttccaggaacagtccccagacctcctcatctatgataacaacaatccggccctcagggtcccctgaccggttctctggctccaagtctggcacctcagcctccctggcccatccactgggcctccagactgaggatgaggctgattattactgccagtcctatgacagcaactgagcggttgggtgttcgggcggagggaccga

SEQ ID NO: 782147 - DNA, 487 bp, Homo sapiens
  misc_feature: HIJSMM301B9YIR.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggttggatctaggacagaattcactctcaccatcaccaacctgcaccctgagatgttggaagtttattactgtcagacctatagtggtggcccgctctagttttcggcggagggaccaaggtgcagatcaaacgaactgtggctgca

SEQ ID NO: 782148 - DNA, 495 bp, Homo sapiens
  misc_feature: HIJSMM301DC550.17.35.D02.1.454.light.4.raw
cgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtacaaacgaacgtgtaggtctgccaccatcctgtcttt

SEQ ID NO: 782149 - DNA, 487 bp, Homo sapiens
  misc_feature: HIJSMM301CS1D9.10.53.E09.1.454.light.4.raw
catagtagtgcacgaccggtgctcgatttagagagagtgtgttggggtttgggggagctacaacaggcaggcagggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagtctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaacgaa

SEQ ID NO: 782150 - DNA, 507 bp, Homo sapiens
  misc_feature: HIJSMM301CBESH.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctggaggatgttgcggtttattactgcctgcagagtattcactggccggtggacgttcgggccaagggaccgaaggtgggaaatcgaaaacgaacgtgtggctgtcacc

SEQ ID NO: 782151 - DNA, 515 bp, Homo sapiens
  misc_feature: HIJSMM301EQU0M.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggacagctgaccgtctaggtcagccaaggctcgccccctcggtcactctcgttccccaccctccctcctacgtctaccg

SEQ ID NO: 782152 - DNA, 500 bp, Homo sapiens
  misc_feature: HIJSMM301B263Y.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgccttccactttggaaagtggggtcccatcaagattcagcggtagtggatctgggacagaattcactctcaccgtcagcagcctgcagcctgaagtattttgactaacttattactgtcaactagtttaataactaccctctcactttcggaggaggaccgagggtggagatacaaacgaactgtggtctgcaccatctgtcttcta

SEQ ID NO: 782153 - DNA, 501 bp, Homo sapiens
  misc_feature: HIJSMM301CEWCF.52.60.F05.1.454.light.4.raw
cgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaatgggaccaaggtcaccgtcctaggtcagcccaaggcccaaccccactcgtcactctccg

SEQ ID NO: 782154 - DNA, 507 bp, Homo sapiens
  misc_feature: HIJSMM301EW45V.9.21.B10.1.454.light.4.raw
tgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattacttgcagctcatatgcagtttggttccttctttcaagactattccggcgggagggaccgaggctgaccgtcctgagtcagcccaaggctcgccccctc

SEQ ID NO: 782155 - DNA, 506 bp, Homo sapiens
  misc_feature: HIJSMM301CHBE3.41.21.B10.1.454.light.4.raw
tctatactatcacgaccggtgctcgatttagtgtcgtcgcaagagagggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaaggggcattcggccaagggaccaaggtggaaattaaacgaactagtggctgcaccatctgtcttcatcttcccgccta

SEQ ID NO: 782156 - DNA, 506 bp, Homo sapiens; identical to SEQ ID NO: 708676
  misc_feature: HIJSMM301C5RXB.15.1.A01.1.454.light.4.raw

SEQ ID NO: 782157 - DNA, 505 bp, Homo sapiens
  misc_feature: HIJSMM301BCWT6.41.53.E09.1.454.light.4.raw
tctatactatcacgaccggtgctcgatttagagagagtgtgttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctgctccaagtctggcaacacggcctccctgacccatctctgggctccaggctggaggacggaggctgattattactgcagctcatatacaagcagcagcactctcgtgggtattcgggcggagggaccaaggctggaccgtcctaggtccagcccaaggct

SEQ ID NO: 782158 - DNA, 501 bp, Homo sapiens
  misc_feature: HIJSMM301DE13N.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagccctgcagcctgatgatttggcaacttactactgccaaccgtatagtacttattcggtcaccttcggaccaacgggacacgactggagattaaacgactagtggctgcaccatctgtcttcattccc

SEQ ID NO: 782159 - DNA, 496 bp, Homo sapiens
  misc_feature: HIJSMM301A36JA.47.55.E11.1.454.light.4.raw
agctcacgtacacgaccggtgctcgatttagcactcgcacgttgggtttggggagagagaccccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtagggttgggatcgcagcctgactgcttacgtcttcggagctgggaccaaggtcaccgtcctaggtcagccccaaggcccaaccccactgtcactctgttcccgcccctcctctacgtgagct

SEQ ID NO: 782160 - DNA, 505 bp, Homo sapiens
  misc_feature: HIJSMM301A23AT.8.42.D09.1.454.light.4.raw
ctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggaggaccggaattgaccgtcctaggtcagcccaaggctcgccccctcggtcactctcgtt

SEQ ID NO: 782161 - DNA, 518 bp, Homo sapiens
  misc_feature: HIJSMM301AN8PW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggcctccgacaacaagaactacttagcttggtatcagcagaaaccaggacagcctcctaaactgctcattaactgggcatctacccggcaactccggggtccctgaccgattcagtggcagcgggtctgggacagatttcactctcaccatcagcagccctgcaggctgaagatgtggcagttttattactgtcaactagttttctcgggcgtcgtcacggacgaacggtaggaaagtacaaacgaaactacgtaggtcgtgtcaccgactctgtcttctatcttccccg

SEQ ID NO: 782162 - DNA, 493 bp, Homo sapiens
  misc_feature: HIJSMM301AMPV2.3.10.A10.1.454.light.4.raw
agacgcactccacgaccggtgctcgatttagcgtcgatctcagggggcgtgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtcccaggcagaggacgaggctgactattattgtcaatcagcagacaacagtaatacttatctttatgtcttcggatctgggaccagggtccaccgtcctaggtcagcccaaggcccaacccc

SEQ ID NO: 782163 - DNA, 481 bp, Homo sapiens
  misc_feature: HIJSMM301ASL9I.41.57.F02.1.454.light.4.raw
tctatactatcacgaccggtgctcgatttagctcgatatagttgggtttggggctccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggcccaccctcccaaattgctatcatacaggaagaacaaccgcccctcggggatctccgagagattctctgcatcaacgtcaggaaacatagcctccctgaccatactggactccagcctgaggacgaggctgactattactgctcagcatggacagcagcctcaattgttgggtggttcggcggagggaccaagactgacccgtcc

SEQ ID NO: 782164 - DNA, 531 bp, Homo sapiens
  misc_feature: HIJSMM301A5BES.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcaccaaagaatcggttcttttggggtccctgatcgcttctctggctccatccttgggaacaaggctgcccctcaccatccgacgggggccccaggcagatgatgaatctaattatcactgtgcgttgtatagttgggttttggctattttcggtgttcgggcggacgggacccagggtcgaccgtcctacgtcacgcccaaggtccg

SEQ ID NO: 782165 - DNA, 484 bp, Homo sapiens
  misc_feature: HIJSMM301DT9LC.46.26.C04.1.454.light.4.raw
  modified_base (459)..(459): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcaagcagagtggaggctgaggatgttgggctctattattgcatgcaagctctacaagtcccgctcacttcggcggngggaccagggtgagaatcaaacgaa

SEQ ID NO: 782166 - DNA, 491 bp, Homo sapiens
  misc_feature: HIJSMM301EVEXV.40.83.H06.1.454.light.4.raw
  modified_base (331)..(331): a, c, t, g, unknown or other
tctagcgactcacgaccggtgctcgatttagatcacgtgcgtcgcggggtccaaacagagcttcagcaagcatagtggggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagngatattctgcatccaggttcgcgaacacagcctccctgaccatcactggactcaagcctgaggacgaggctgactattactgttcagcgatgggaccggcagcctcagtgaatgggtgttcggcggagggaccaaaactgtccgtcctaggtcagacccg

SEQ ID NO: 782167 - DNA, 533 bp, Homo sapiens
  misc_feature: HIJSMM301D6WKB.27.23.C01.1.454.light.4.raw
  modified_base (526)..(526): a, c, t, g, unknown or other
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatataacaaccagtgacacgttgggtgttcgggcgggacgggaccaggctggaccgtcctaggtcagcccaaggctcgccccctcggtcactctcgttcccnccctccc

SEQ ID NO: 782168 - DNA, 473 bp, Homo sapiens
  misc_feature: HIJSMM301AL7FP.11.70.G04.1.454.light.4.raw
  modified_base (438)..(438): a, c, t, g, unknown or other
  modified_base (465)..(465): a, c, t, g, unknown or other
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgctaacttattactgtacaaaagataagcgctgccccgctcngtttcggcggagggaccgaaggtgganagtaaccg

SEQ ID NO: 782169 - DNA, 487 bp, Homo sapiens
  misc_feature: HIJSMM301C1V2U.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtcttattactgtcagcagtatggtcacgtcccaagtaacttttggccaggggaccaagctggagatcaaacgaactgtggctgcacc

SEQ ID NO: 782170 - DNA, 485 bp, Homo sapiens
  misc_feature: HIJSMM301COVLY.40.57.F02.1.454.light.4.raw
  modified_base (471)..(471): a, c, t, g, unknown or other
tctagcgactcacgaccggtgctcgatttagctcgatatagttggggtttgggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcgccctcaggggtcgctgatcgcttctctggctccaagtctggcgacacggcctccctgaccatctctgggctccagactgaggatgaggctacttattttgctgctcttatgcaggcagtttcgctctcgaagtgtcggcggagggaccgagcngaccgtcctacgtc

SEQ ID NO: 782171 - DNA, 500 bp, Homo sapiens
  misc_feature: HIJSMM301CPYQ9.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctactcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattattctgcggctcatatggagacaattacagctttgtcttcggaagtgggaccaaggtcaccgtctaagtcagccaaggccaacccactgtcactctgttcccgcct

SEQ ID NO: 782172 - DNA, 453 bp, Homo sapiens; identical to SEQ ID NO: 545340
  misc_feature: HIJSMM301EADS4.19.86.H09.1.454.light.4.raw

SEQ ID NO: 782173 - DNA, 500 bp, Homo sapiens
  misc_feature: HIJSMM301AUVCD.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctactcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccgaagggaccaagggtggaatatcagacgaactgtggctgca

SEQ ID NO: 782174 - DNA, 501 bp, Homo sapiens
  misc_feature: HIJSMM301DCVDW.51.46.E02.1.454.light.4.raw
  modified_base (488)..(488): a, c, t, g, unknown or other
cgatcgtatacacgaccggtgctcgatttagactcatctacagggaaagggggtgatcaggactcctcagttcaccctctcacaatgaggctccctgctcagctcctggggctgctaatgctctgggtcccaggatgcagtggggctgttgtgatgactcagtctccactctccctgcccgtcacccttggacagccggcctccatctcctgcaggtctagtcaaggcctcgtttatagtgatggagacacctacttgagttggtttcaccagaggccaggccaatctccaaggcgcctaatttataaggtttctaaccgggactctggggtcccagacaaattcagcggcagtgggtcaggcactgatttcacactgaaaatcagcagggtggaggctgaggatgttgggatttactactgtatgcaaggtacgacactggcctctcactttcggcggagggaccaaggtggagatgaacgaactgnggctgcaccatct

SEQ ID NO: 782175 - DNA, 496 bp, Homo sapiens; identical to SEQ ID NO: 574100
  misc_feature: HIJSMM301AU5LG.47.64.F09.1.454.light.4.raw

SEQ ID NO: 782176 - DNA, 385 bp, Homo sapiens
  misc_feature: HIJSMM301AFYIX.41.26.C04.1.454.light.4.raw
tctatactatcacgaccggtgctcgatttagtctagcgactttgggtttgggggaaagagccaccctctcctgcagggctagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgcccatctgtaatagtataga

SEQ ID NO: 782177 - DNA, 500 bp, Homo sapiens
  misc_feature: HIJSMM301DU2OL.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcactaaaccttcggaccagggggacacggactggagattaagcgaactgtaggctgcaccatctgtctt

SEQ ID NO: 782178 - DNA, 499 bp, Homo sapiens
  misc_feature: HIJSMM301BABPS.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagtattttgctagtttattacttgtcagcactataataacgtggcctccgtactagttttggccgtaggggaccaagctggagatacaaacgaactggtggctcg

SEQ ID NO: 782179 - DNA, 512 bp, Homo sapiens
  misc_feature: HIJSMM301CSYDM.16.1.A01.1.454.light.4.raw
  modified_base (366)..(366): a, c, t, g, unknown or other
tgtactactccacgaccggtgctcgatttagacgtctcatcaggaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctcccngaccgtctctggcctcagactgaggacgaggctgattattactgccactcatatagaagtagtactactcctgtggttttcggcggagggaccaagctgaccgtcctaggtcagtccaaggctccgcccctccggtcactcttccg

SEQ ID NO: 782180 - DNA, 507 bp, Homo sapiens
  misc_feature: HIJSMM301DGSO0.17.87.H10.1.454.light.4.raw
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggtaggcaccaaggtgaccgtcctaggtcagcccaaggctgcccctcggtcta

SEQ ID NO: 782181 - DNA, 505 bp, Homo sapiens
  misc_feature: HIJSMM301AN0MZ.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtccactcc

SEQ ID NO: 782182 - DNA, 527 bp, Homo sapiens
  misc_feature: HIJSMM301C8SVE.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattatgtagttcatatacaaccagtgactacttgggtgttcgggcggagggaccaggctaggaccgtcctaggtcacggccaaggctcgccccctcggtccactctgttccccacct

SEQ ID NO: 782183 - DNA, 489 bp, Homo sapiens
  misc_feature: HIJSMM301DGOJV.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcgtcaccttcggccaagggacacgactggagattaaagaactgtggctgcaccatctgtctt

SEQ ID NO: 782184 - DNA, 517 bp, Homo sapiens
  misc_feature: HIJSMM301BKOF5.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaaggtcagcccaaggctcgccccctcggtccactcttcccg

SEQ ID NO: 782185 - DNA, 505 bp, Homo sapiens
  misc_feature: HIJSMM301BL4LA.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagtattttgctagttttattactgtcagcagtatgagaagtggttcaagtactttcggcggagggaccgaagggtggagatacaaacgaactgtggctgcaccatcgtgtcttctattcc

SEQ ID NO: 782186 - DNA, 485 bp, Homo sapiens
  misc_feature: HIJSMM301B7DWH.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttaggaacttattactgccaacaatataatagttattggacgttcggccaggggaccaaggtacgaaatgagacgaacgtgtggctgcaccat

SEQ ID NO: 782187 - DNA, 515 bp, Homo sapiens
  misc_feature: HIJSMM301CTUH0.7.34.D01.1.454.light.4.raw
cgtgtctctacacgaccggtgctcgatttagatcgtctgtgttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaagcctgccccctcggtccactcc

SEQ ID NO: 782188 - DNA, 513 bp, Homo sapiens
  misc_feature: HIJSMM301BI0LT.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaacgcccccaaactcatctatttatgatgtcactgctccggccctcgtaggggtttctcatcgtcttttctggctccaagtctggcaccacggcctccctgaccatctcggggctccgaggctgaggacgaggctgcttattactgcagctcatatacaaggagcaccactctcgtggtatttggtggaggaccaagctgaccgtcctaggtcacgccaaggctcgccccctcggt

SEQ ID NO: 782189 - DNA, 532 bp, Homo sapiens
  misc_feature: HIJSMM301B24S1.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcacgcccaaggcctcgcccccctcggtaccactctcgttcccccacccgttcccttacccg

SEQ ID NO: 782190 - DNA, 376 bp, Homo sapiens
  misc_feature: HIJSMM301DVYAD.9.11.A11.1.454.light.4.raw
tgatacgtctcacgaccggtgctcgatttagctacgactgcaggggagagagccaccctctcttgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggagcctgaagattttgcagtttattactgtcagcagtatggtagctcaccgtacacttttggccaggggaccaagctggagatcaaacgaactgtggctgcaccatctgtcttcatcttcccgccatctgaaagacgtatca

SEQ ID NO: 782191 - DNA, 510 bp, Homo sapiens
  misc_feature: HIJSMM301C9GFW.15.1.A01.1.454.light.4.raw
tctacgtagccacgaccggtgctcgatttagacgtctcatcaggggggggtcacaagaggcagcgctctcgggacgtctccaccatcggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgtctgctcatatgaaggttataaacacttatactattcgggcggagggaaccaagctcggaccgtcctgcgtcagcccaggctcgccccctggtccactc

SEQ ID NO: 782192 - DNA, 500 bp, Homo sapiens
  misc_feature: HIJSMM301B8TIL.8.12.B01.1.454.light.4.raw
ctcgcgtgtccacgaccggtgctcgatttagtagtgtagattccgcggggcgtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagccgggacccaggctacggatgaggctgactattactgtcaggcgtgggacaggcacgcacctagtgttgggttttcggcgggagggaccaaggctgaccgtccttggtcagcccaaggcctgtcccccccg

SEQ ID NO: 782193 - DNA, 503 bp, Homo sapiens
  misc_feature: HIJSMM301A4162.18.78.H01.1.454.light.4.raw
tacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagccccaaactcatgatttatgatgtcagtaatcggccctcaggggtttctaatcgcttctctggctccaagtctggcaacacggcctccctgaccatctctgggctccaggctggagacgaggctgattattactgcagctcatatacaagcagcagcactcaagtcttggaactgggaccaaggtcacgtcctaggtcagccaaggccaaccccactgcta

SEQ ID NO: 782194 - DNA, 510 bp, Homo sapiens
  misc_feature: HIJSMM301CQODN.47.85.H08.1.454.light.4.raw
  modified_base (453)..(453): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggngggaccaagttgaccgtcctagtcagcccaaggctgccccctcggtccactctcgtt

SEQ ID NO: 782195 - DNA, 516 bp, Homo sapiens
  misc_feature: HIJSMM301EWGNG.49.23.C01.1.454.light.4.raw
  modified_base (235)..(235): a, c, t, g, unknown or other
agtcgagagacacgaccggtgctcgatttagtacacgtgattagggattgggggtgggctcaggaggcagagctctgggaatctcaccatggcctggacccctctcctgctcccactcctcactttctgcacagtctctgaggcctcctatgagctgacacagtcaccctcgctgtcagtgtccccaggacaaacggccaggatcacctgctctggagatgcattgccaaaaagntatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggaatgagggtgattactactgttactcaacagacattactactactcatagggtgttcggcggagggaccgaagctgaccgtcctaggtacacgcccaaggctcgccccctcggtccactctcgttcccta

SEQ ID NO: 782196 - DNA, 514 bp, Homo sapiens
  misc_feature: HIJSMM301DZ92K.9.12.B01.1.454.light.4.raw
  modified_base (498)..(498): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctcgaccgattcagtggcagcgggtctgggacagatttcactctcaccatcagcagcctgcaggctgaagatgtggcagtttattactgtcaactagttttctcgggcgttcggccgaacggaccgaaggtaggaaatacgaaaacaactagtgtctgcaccatctcgtnttactatccttccccg

SEQ ID NO: 782197 - DNA, 505 bp, Homo sapiens
  misc_feature: HIJSMM301ELA04.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttacggaactgggaccaaggtcaccgtcctaggtcagaccccaaggcccaacccca

SEQ ID NO: 782198 - DNA, 497 bp, Homo sapiens
  misc_feature: HIJSMM301C6XC6.15.25.C03.1.454.light.4.raw
  modified_base (383)..(383): a, c, t, g, unknown or other
tctacgtagccacgaccggtgctcgatttagtagtgtagatttgggtttgggggatcaggactcctcatttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatnagcagagtggaggctgaggacgttggggtttattactgcatgcaggtctacaacccgactcaccttcggccgagggacacgcctggagattaaacgaactagtggctgcaccat

SEQ ID NO: 782199 - DNA, 496 bp, Homo sapiens
  misc_feature: HIJSMM301DIV6D.46.35.D02.1.454.light.4.raw
actagcagtacacgaccggtgctcgatttagcacacgatagttggggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatccagcagactgagcctgaagattttgcagtctattactgtcagcagtactggtcacggtcccaacgtaacttttggcacggggaccaaaggctggagagtacaaacgaactgtggctgcaccatt

SEQ ID NO: 782200 - DNA, 498 bp, Homo sapiens
  misc_feature: HIJSMM301AS26A.41.33.C11.1.454.light.4.raw
  modified_base (420)..(420): a, c, t, g, unknown or other
tctatactatcacgaccggtgctcgatttagagtgagctcgttgggtttgggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggtattatgcagtttactactgtctgcagtanaaagactggcctagggtcacgtttcggcccgtgggaccaaagtggatttcaaaccgaatggtggtctggccaccattc

SEQ ID NO: 782201 - DNA, 480 bp, Homo sapiens
  misc_feature: HIJSMM301EC1BV.51.67.G01.1.454.light.4.raw
cgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagatttttactttcaccatcagcaggctgcagcctgaagacattgcaacatattactgtcaacagtatgatagtcctccgctcactttcgggcgggggaccgaaggtggagatcaagcgaactgtggctgctacc

SEQ ID NO: 782202 - DNA, 507 bp, Homo sapiens
  misc_feature: HIJSMM301EVO0G.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcaggtgggtatgggacagacttcactctcaccatcatcagcctggagcctgaagatgttgctagtttattactgtcaacatcgtaccgagtggcctccgggggccacttcggccctcgggaccgaaagtggagatacaaacgaactgtggctgcaccta

SEQ ID NO: 782203 - DNA, 495 bp, Homo sapiens
  misc_feature: HIJSMM301DM6MM.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctggaggatgaggctgactattactgccagtcgtatgacagtggcctaagtaacatcgtcttcggaacgtgggaccaaggtcaccgttcc

SEQ ID NO: 782204 - DNA, 452 bp, Homo sapiens
  misc_feature: HIJSMM301A95AL.40.53.E09.1.454.light.4.raw
tctagcgactcacgaccggtgctcgatttagagagagtgtgttgggtttgggggccgttcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttggtgttcggcgggggaccaagctgaccgccctaagtcagcccaaggctgccccctcggtcactctgttcccaccctcctcagtcgctaga

SEQ ID NO: 782205 - DNA, 404 bp, Homo sapiens; identical to SEQ ID NO: 572588
  misc_feature: HIJSMM301A4ESF.11.67.G01.1.454.light.4.raw

SEQ ID NO: 782206 - DNA, 517 bp, Homo sapiens
  misc_feature: HIJSMM301E1HPA.4.28.C06.1.454.light.4.raw
agcactgtagcacgaccggtgctcgatttagagctcacgtattgggtttggggctgggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctccagaggccaggccactcccctattctagtcatgtatcaaactacgaagcgcccctcaggggtccctgagcgcttttctggctccaagtctggggacacagccactctgactctctccggggcccaggccatcgatgagggagactattactgtcaggcgtgggacagcacaactgcagtcttcggcggagggaccagggtgaccgtcctcgggtcagcccaacggctcggccccctcgggtccactcctgttcccacccctt

SEQ ID NO: 782207 - DNA, 528 bp, Homo sapiens
  misc_feature: HIJSMM301AS6FN.51.28.C06.1.454.light.4.raw
  modified_base (351)..(351): a, c, t, g, unknown or other
cgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctcaactctgggaacncagccactctgaccatcagcgggaccgcaggctgtggatgaggctgacttttactgtccaggtcgtgggacaggtcgaacaccgtgccggtggttccgggcggggggacctaaggcctcggacccggttccctcggtccacggcccaacggccttcggcccccccggtccgtacccg

SEQ ID NO: 782208 - DNA, 497 bp, Homo sapiens
  misc_feature: HIJSMM301E1IZK.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggctaacttactactgccaccgtatagttacttattacggttcaccttcggtcaagggacacgactggagattaaacgaactgt

SEQ ID NO: 782209 - DNA, 516 bp, Homo sapiens
  misc_feature: HIJSMM301ADHJ5.49.1.A01.1.454.light.4.raw
agtcgagagacacgaccggtgctcgatttagacgtctcatcaaggaagggaagggggggggtctcaggaggcagcgctctcaggacgttaccaccatggcctgggctctgctcctcctcaccctcctcactcagggcacagggtcctgggcccagtctgccctgactcagcctccctccgcgtccgggtctcctggacagtcactcaccatctcctgcactggtggttataactctgtctcctggtaccaacagcacccaggcaaacgcccccaaactcatgatttatgaggtcaataggcggccctcaggggtccctgatcgcttctctggctccaagtctggcaccacggcctccctgaccgtctctgggctccaggcagaggatggaggctgattattactgcagctcatctgcaggcattaactaattttaatgttggtattcggcggagggaccagctgaccgtcctaggtcagccaaggctcgccccctcggtcactctcgtcccaccct

SEQ ID NO: 782210 - DNA, 535 bp, Homo sapiens
  misc_feature: HIJSMM301BCGQM.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgactacttgggtgttcggcggagggaccaggcctgaccgtcctacggtcagcccaaggcctcggccccctcgggtcacctctcgttccccacccttccc

SEQ ID NO: 782211 - DNA, 483 bp, Homo sapiens
  misc_feature: HIJSMM301D0O49.9.12.B01.1.454.light.4.raw
  modified_base (481)..(481): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaaactgggcatctaacccggcaatccggggtccctgaccgattcagtggcagtgggtctgggacagacttcactctcaccatcagcagactggagccctgaggtattttgcagtgtattactgtcagcatatcataggtcaaacaaccttcgaccaggaacacgatagagtataaagaaagtgngt

SEQ ID NO: 782212 - DNA, 504 bp, Homo sapiens
  misc_feature: HIJSMM301EY56J.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaagcctgccccctcggt

SEQ ID NO: 782213 - DNA, 497 bp, Homo sapiens
  misc_feature: HIJSMM301EVHNO.10.72.G06.1.454.light.4.raw
catagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacaccccaggggcactcgtcgtgatattcggcggagggacctggcctgaccgtcctaggtcagcccaac

SEQ ID NO: 782214 - DNA, 495 bp, Homo sapiens
  misc_feature: HIJSMM301EBT66.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgagtccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccgaagctgaccgtcctgcggtcacgcccaaggcctcgccccctcggtccactctcgttccccaccccctccgcctaccgtaga

SEQ ID NO: 782215 - DNA, 511 bp, Homo sapiens
  misc_feature: HIJSMM301B9TAE.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctcgtggctccaagctgaggatgacggctgattattactgcagctcatatgcaggcagcagcaattgtacttttcggcggagggaccaagctgaccgtcctgggtccagccctaaggcctcgccccctggtcctac

SEQ ID NO: 782216 - DNA, 522 bp, Homo sapiens
  misc_feature: HIJSMM301CN52K.27.23.C01.1.454.light.4.raw
  modified_base (507)..(507): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttgggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaccagtgacacttgggtgttcggcggagggaccaggctgaccgtcctaggtcagcccaaggctgccccctcggtcnctctgttcccgccct

SEQ ID NO: 782217 - DNA, 518 bp, Homo sapiens
  misc_feature: HIJSMM301C9SGD.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcgttgggcaactactgtcgtttgggtgttcggcggagggaccaagttgaccgtcctaggtcagcccaaggctcgccccctcggtcactctcgttcccccg

SEQ ID NO: 782218 - DNA, 503 bp, Homo sapiens; identical to SEQ ID NO: 547621
  misc_feature: HIJSMM301ER4SY.40.67.G01.1.454.light.4.raw

SEQ ID NO: 782219 - DNA, 515 bp, Homo sapiens
  misc_feature: HIJSMM301AV6JU.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggccaagttgaccgtcctaggtcagcccaaggcctgccccctcggtcactttcgttcccgt

SEQ ID NO: 782220 - DNA, 498 bp, Homo sapiens
  misc_feature: HIJSMM301EGG57.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggaattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatggttggggtttattactgcatgcaagttctaacaaacttaccgtactacttttggccaggggaccaaggctggagactacaaacgaactggt

SEQ ID NO: 782221 - DNA, 504 bp, Homo sapiens
  misc_feature: HIJSMM301EXVZF.9.1.A01.1.454.light.4.raw
  modified_base (486)..(486): a, c, t, g, unknown or other
tgatacgtctcacgaccggtgctcgatttagacgtctcatcaggggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcaagaaatctggccagcctcccaggctcctcatctatggtgaatccaacagggccactggcatcccagacaggttcagtggcagtgggtctgggacagacttcactctcaccatcagcagactggagcctgaggtattttgcaggtgtattactgtcagcagtatacataggtacaaacaccttcggccgaagggacaacgacgtggagattaaaggaactagtgctgcaccatntgtcttctatcttccccg

SEQ ID NO: 782222 - DNA, 500 bp, Homo sapiens
  misc_feature: HIJSMM301B7VZC.51.57.F02.1.454.light.4.raw
cgatcgtatacacgaccggtgctcgatttagctcgatatagttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcagcatcacttgccgggccactgagaatattcataattggttggcctggtatcagcagaaaccagggaaagcccctaaactcctgatatataagacgtctaatttagaaggtggggtcccatcaaggttcagcggcggtggctctgggacagaattcactctcaccatcaccagcctgcagcctgatgattttgcaacttattactgccaacagtattatagttattggacgttcggccaagggaccaaggtggaaatcaaacgaactggtggctgcaccatctgtcttcatcttccccg

SEQ ID NO: 782223 - DNA, 451 bp, Homo sapiens
  misc_feature: HIJSMM301B349I.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttctatgtcttcggatctgggaccaaggtcaccgtcctaagtcagcccaaggcccaacccctctcgtcactctcgttccccaccctcctccatactcgta

SEQ ID NO: 782224 - DNA, 504 bp, Homo sapiens
  misc_feature: HIJSMM301BE9QF.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccacctgaccatcagcagggtcgaaggccggggatggaggccgactattactgtcaggtgtgggatagtagtggtgatcatcctatacgtcttcggaactgggaccaaggtctccgtcctacgtcagccaagccaactcactgtcactc

SEQ ID NO: 782225 - DNA, 511 bp, Homo sapiens
  misc_feature: HIJSMM301BOIY8.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctccttcagtacggttcggacccgaagggacccgaaaggttggaaaatccaaagaacctgtggcctgcctacc

SEQ ID NO: 782226 - DNA, 518 bp, Homo sapiens
  misc_feature: HIJSMM301AER4K.3.87.H10.1.454.light.4.raw
agacgcactccacgaccggtgctcgatttagcagtactgcgttgggtttgggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcagggtttctcatcgctttctggctccaagtctggcaacacggcctccctgaccatctctgggctccaggctgaggacgaggctgattatttctgcagctcatacacaaccggcaccactgtcgtggttttcgtggagggaccaagctgaccgtctaggtcagcccaaggctcgccccctcggtcacttcc

SEQ ID NO: 782227 - DNA, 502 bp, Homo sapiens
  misc_feature: HIJSMM301AMA3L.19.78.H01.1.454.light.4.raw
  modified_base (467)..(467): a, c, t, g, unknown or other
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaacggccaaccccacngtcactctcgttcccaccctcctccaccgagagta

SEQ ID NO: 782228 - DNA, 527 bp, Homo sapiens
  misc_feature: HIJSMM301AILTI.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttcgtcgggctccagctctggggccgagcgctacctcaccatctccagcctccagtctgaagatgaggctgactattactgtcagacagtgggacgcgtggcgtctggctgttcggcggagggaccaaggctgaccgtcctaggtcagcccaaggccgtcgccccctcggtccactctcgttcccgccctcctcacg

SEQ ID NO: 782229 - DNA, 526 bp, Homo sapiens
  misc_feature: HIJSMM301C1VNP.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgcccccttggtccactctgttcccgcccttcc

SEQ ID NO: 782230 - DNA, 515 bp, Homo sapiens
  misc_feature: HIJSMM301BU3C0.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgcccccaaactcataatttatgacgtcaatgttcgcccctcgaggggtttctcatcgcttctctggctccaaatctggcaacacggcctccctgaccatctctgggctcgagtctgaggacgaggctgattacttctgttgctcttgggctaactactgtcgtttgggtgtttcgggcggagggaccgaagttgaccgtcctaggtcaggcccaaggctgccccctcggtccact

SEQ ID NO: 782231 - DNA, 507 bp, Homo sapiens
  misc_feature: HIJSMM301EBU62.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaacggctgccccctcggtccta

SEQ ID NO: 782232 - DNA, 445 bp, Homo sapiens
  misc_feature: HIJSMM301AF5D0.8.73.G07.1.454.light.4.raw
  modified_base (439)..(439): a, c, t, g, unknown or other
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctcgccccctcggtcactctgttcccaccctcctcgacncgcgag

SEQ ID NO: 782233 - DNA, 483 bp, Homo sapiens
  misc_feature: HIJSMM301AW9OM.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggacttcggcctgggactaaggtggagatcagacgaactggtggctgcacatctgtcttcta

SEQ ID NO: 782234 - DNA, 511 bp, Homo sapiens
  misc_feature: HIJSMM301EE23E.16.46.E02.1.454.light.4.raw
tgtactactccacgaccggtgctcgatttagactcatctacagggaaaggggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaattacttttgtctttcggaactgggaccaaggtcacgtcctaggtcagcccaaggccaacccactgtcactctcg

SEQ ID NO: 782235 - DNA, 497 bp, Homo sapiens
  misc_feature: HIJSMM301EESFM.51.55.E11.1.454.light.4.raw
cgatcgtatacacgaccggtgctcgatttagcactcgcacgttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactggccgtggtcggcggggggaccaagctgaccgtcctcggtcacgccgaacggctcgccccctcggtcc

SEQ ID NO: 782236 - DNA, 503 bp, Homo sapiens
  misc_feature: HIJSMM301EH9AV.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggctcccaggctcctcatctatgatgcatccaccagggccaccggtatcccagcctaggttcaggtggcaggtgggtctgggacagagttcactctcaccatcagcagcctgcagtctgaggtattttgctagtttattactgtcagcattacaataactggcctcggctcactttcgggcggagggaccgaaggtggagatacaaacgaactggtggctgaccaccatcttcg

SEQ ID NO: 782237 - DNA, 507 bp, Homo sapiens
  misc_feature: HIJSMM301BR90Q.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggccctccctgaccatctctgggctcgagtctgaggacgaggctgattacttctgttgctcttgggcaactactgtcgtttgggtgttcggcggagggaccagtgacgtcctggtcagcccaaggctcgccccctcggtcactctgtt

SEQ ID NO: 782238 - DNA, 446 bp, Homo sapiens
  misc_feature: HIJSMM301B5V02.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccatcctatgacaacagcctgagtatttggctgttcgggcggcgggaccaagttgaccgtcctacgtcagcccaaggctcgccccctcggtcactctcgttcccaccctcctcgacacgcgag

SEQ ID NO: 782239 - DNA, 499 bp, Homo sapiens
  misc_feature: HIJSMM301EIN23.15.1.A01.1.454.light.4.raw
  modified_base (353)..(353): a, c, t, g, unknown or other
  modified_base (473)..(473): a, c, t, g, unknown or other
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctctggtaccaacaccaccccggcagagcccccaaactcatgatttatgaggccactaagcgacctcagggctttctaatcgcttctctggctccaagtctggcaacncggcctcctgacaatctctgggctccaggctgacgacgaggctaattattactgctgctcatatgaaggttataacactatactattcggcggagggaccaagcctgaccgtctcgcgtnagcccaaggctgccccctggtccact

SEQ ID NO: 782240 - DNA, 491 bp, Homo sapiens
  misc_feature: HIJSMM301B6821.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtccaccgtcctaggtccagcccaaggcccaaccccta

SEQ ID NO: 782241 - DNA, 501 bp, Homo sapiens
  misc_feature: HIJSMM301AHWFU.14.55.E11.1.454.light.4.raw
cgtctagtaccacgaccggtgctcgatttagcactcgcacgttgggttttgggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatctaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgctaacttactactgtcaacagagttacacgtacccccctctactttcggcggacgggaccgaaggcggagatcaagacgaactgtggctagcaccatctgttcttcta

SEQ ID NO: 782242 - DNA, 495 bp, Homo sapiens
  misc_feature: HIJSMM301AT4D6.3.10.A10.1.454.light.4.raw
  modified_base (435)..(435): a, c, t, g, unknown or other
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcgagggacaacagtcacgttgaccatcagtggagtccaggcagaggacgaggctgactattatgtcaatcagcagacaacagtaatacttatctttatgtnttcggatcgtgggccagggttcacgtcctaggtcagccccaaggcccaacccctactacg

SEQ ID NO: 782243 - DNA, 527 bp, Homo sapiens
  misc_feature: HIJSMM301A2AK6.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattcgtagttcatatacaaccagtgacacttgggtgttcgggcggagggaccaggctgaccgtcctaggtcagcccaaggctcgccccctcggtcactctcgttcccaccctt

SEQ ID NO: 782244 - DNA, 477 bp, Homo sapiens
  misc_feature: HIJSMM301B95UM.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatcccctgagcgattctctggctccaactctgggaactcagccactctgaccatcagcgggacccaggctatggatgaggctgactattactgtcaggcgtgggacaggcagcactgcccgctatgtcttcggaactggaccaaggtcaccgtcctaagtcagaccccg

SEQ ID NO: 782245 - DNA, 509 bp, Homo sapiens
  misc_feature: HIJSMM301EHCJV.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcacgcccaaggccaaccccta

SEQ ID NO: 782246 - DNA, 484 bp, Homo sapiens
  misc_feature: HIJSMM301AFKQE.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcacccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgcggtttattactgtcagcagtatgataactggctgtactacttttggccaggggaccaagctggagatcaggcgaactgtggctgca

SEQ ID NO: 782247 - DNA, 499 bp, Homo sapiens
  misc_feature: HIJSMM301DR7BY.16.75.G09.1.454.light.4.raw
tgtactactccacgaccggtgctcgatttagtatagacatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgtaggtcgttataactatgtctcctggtaccaacaacacccaggcaacgcccccaggctcatgatttatgaggtcaatgatcggccctcaggaatttccaatcgcttctctggctccaagtctggcaacacggcctccctgacaatctctgacctccagccctgaggacgaggctgaatattactgcagttcatatacaactaagagttcttgtggtattcggcggtagggaccaagctgacagtcctaggtcagcccaaggctcgccccctc

SEQ ID NO: 782248 - DNA, 486 bp, Homo sapiens
  misc_feature: HIJSMM301BXTJ5.41.53.E09.1.454.light.4.raw
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatccggccctcaggggtttctaatcgcttctctggctccaagtctggcaacacggcctccctgaccatctctgggctccaggctgaggcgaggctgattattactgcagctcatatacaagcagcagcactctcgtggtattcggcggagggaccaagctgaccgtcctagg

SEQ ID NO: 782249 - DNA, 502 bp, Homo sapiens
  misc_feature: HIJSMM301CECGC.43.23.C01.1.454.light.4.raw
tgtgagtagtcacgaccggtgctcgatttagtacacgtgattagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaatcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtctaggtcagcccaaggcctcgccccc

SEQ ID NO: 782250 - DNA, 479 bp, Homo sapiens
  misc_feature: HIJSMM301DPKTC.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccagctgacgatgaggctgattattattgccagtcctatgacaacaccctgcgtggttttggctgttcggcggcggacc

SEQ ID NO: 782251 - DNA, 524 bp, Homo sapiens
  misc_feature: HIJSMM301AJGRI.40.12.B01.1.454.light.4.raw
tctagcgactcacgaccggtgctcgatttagtagtgtagattccgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaatcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaaggtcagcccaaggctcggccccctcggtccactcttgttccctacccc

SEQ ID NO: 782252 - DNA, 500 bp, Homo sapiens
  misc_feature: HIJSMM301DZP5H.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtcggcctccgtacttttggccgagggggccaagctggagatcagacgaactgtggctgcaccatctgtcttcatcttccccg

SEQ ID NO: 782253 - DNA, 505 bp, Homo sapiens
  misc_feature: HIJSMM301C33V0.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccagggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggcccgaggggaccaagcgtggagactcaaacgtaactggtggctcgcaccatctgtt

SEQ ID NO: 782254 - DNA, 490 bp, Homo sapiens
  misc_feature: HIJSMM301EV8PC.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtacccaagtaacttttggccgaggggaccaagctggagatacaaacgaactgtggctgcaccat

SEQ ID NO: 782255 - DNA, 490 bp, Homo sapiens
  misc_feature: HIJSMM301CJHVH.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagctcgaggacgaggctgactattactgttcaagcagtgggacggcagcctcagtgaagtgggtgttcggcggagggacaactgtaccgtcctaggtcagaccccg

SEQ ID NO: 782256 - DNA, 528 bp, Homo sapiens
  misc_feature: HIJSMM301BH4QC.27.23.C01.1.454.light.4.raw
  modified_base (522)..(522): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatcctccgggctccagcctggaggacgaggctgattattattgtagttcatatacaaccagtgacacttgggtgttcggcgggagggaccaggctgaccgtctaggtcagcccaaggctcgccccctcggtcactctcgttcccnccctcc

SEQ ID NO: 782257 - DNA, 507 bp, Homo sapiens
  misc_feature: HIJSMM301AH7WQ.43.82.H05.1.454.light.4.raw
tgtgagtagtcacgaccggtgctcgatttagtcgagctctctcgcggggcagcttcagctgtgggtagagaagacaggactcaggacaatctccagcatggccagcttccctctcctcctcgccctcctcactcactgtgcagggtcctgggcccagtctgtcctgactcagccaccctcagcgtctcgggacccccgggcagagggtcaccatctcttgttctggaagcagctccaacatcggaagtaatactgtaaactggtaccagcagctcccaggaaccggcccccaaactcctcatctacagtattaatcagcggccctcagggatccctgaccgattctctggctccaagtctggcgcctcagccctccctggccatcagtgggctccagtctgaggatgaggctgatttattactgtgctgctatgggatgacagcctgaatgcgttgggttggttccgggcgggacgggaccaaggctgacccggtccgtcgggtcac

SEQ ID NO: 782258 - DNA, 525 bp, Homo sapiens
  misc_feature: HIJSMM301EE2YX.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagacttgcagtttattactgtcagcacttgttttggcggttctccgactttcggcgggtacgggacgaacggtgggaggtacgaaacgtaacgtagtggctggccaccgaatctcgtcttctactcttcccgtcccta

SEQ ID NO: 782259 - DNA, 514 bp, Homo sapiens
  misc_feature: HIJSMM301C55UQ.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactcgtcactcttccg

SEQ ID NO: 782260 - DNA, 490 bp, Homo sapiens
  misc_feature: HIJSMM301ALKQ1.3.10.A10.1.454.light.4.raw
agacgcactccacgaccggtgctcgatttagcgtcgatctcagggggtggggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcaggaggacgaggctagactattattgtacaatcagcagacaacagtaatacttatcttttatgttcgttcggatcgtagggaccagggtcaccgtcctaggtcaggcccaaggcc

SEQ ID NO: 782261 - DNA, 495 bp, Homo sapiens
  misc_feature: HIJSMM301C5DUS.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcgactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 782262 - DNA, 485 bp, Homo sapiens
  misc_feature: HIJSMM301EIJI3.51.76.G10.1.454.light.4.raw
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtcgtgggacagagttcactctcaccatcagcagcctgcagtcgtgaagtattttgctaatttattactgtcagcagtataataactgcctccgtacactttggccagggaccaagctggaggatacaaacgaacgtggtggctgcacc

SEQ ID NO: 782263 - DNA, 507 bp, Homo sapiens
  misc_feature: HIJSMM301AD943.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgttacttttcgggcggagggaccaagctgaccgtccgtgggtcagcccaaggctcgccccctcggtct

SEQ ID NO: 782264 - DNA, 485 bp, Homo sapiens
  misc_feature: HIJSMM301AFIXZ.41.34.D01.1.454.light.4.raw
tctatactatcacgaccggtgctcgatttagatcgtctgtgttggggtttggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaattggaaagtggggtcccatcaaggtttagcggcagtggatctgggacagaattcactctcacgatcagcggcctgcagcctgatgatgtcgcaacttattactgaccacactatgtatagttacccgctcactttcggcggagggaccaaggtggaggtcaagcgaatggtgctgcacctacg

SEQ ID NO: 782265 - DNA, 492 bp, Homo sapiens
  misc_feature: HIJSMM301D1AE7.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatcccgggaatccggggtccctgaccgattcagtggcagcgggtctgggacagatttcactctcaccatcagcagcctgcaggctgaagatgtggcagtttattactgtcagcaatattaatgtactcctccgaggctcactttcggcggagggaccaaggtggagatcaaacgaa

SEQ ID NO: 782266 - DNA, 497 bp, Homo sapiens
  misc_feature: HIJSMM301AZMT6.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagtattttgctagttttattactgtcagcagtatgatacctggcctccgtactacttttgggccgggggacagctaggaaatcaagcgaactgtggctgcaccatctgtcttcatt

SEQ ID NO: 782267 - DNA, 508 bp, Homo sapiens
  misc_feature: HIJSMM301DXYX1.9.53.E09.1.454.light.4.raw
  modified_base (382)..(382): a, c, t, g, unknown or other
tgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctntcgggctccaggctgaggacgaggctgatttatactgctgctcatatgcagatggtgacactccgtggtattcggcggagggaccaaggtgaccgtcctaggtcacgccaacggctcgtccccccg

SEQ ID NO: 782268 - DNA, 514 bp, Homo sapiens
  misc_feature: HIJSMM301ALM5T.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcggggttttcggtcggagggaccaagctgaccgtcctaagtcagcccaaggctcgccccctcggtcactctccg

SEQ ID NO: 782269 - DNA, 514 bp, Homo sapiens
  misc_feature: HIJSMM301A286H.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggacgaagtgtacgtcctaagtcagccaaggctgccccctccggtcactctcgttcccgccctcctccta

SEQ ID NO: 782270 - DNA, 517 bp, Homo sapiens
  misc_feature: HIJSMM301EIIZM.8.34.D01.1.454.light.4.raw
ctcgcgtgtccacgaccggtgctcgatttagatcgtctgtgttggggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggcctcccaggcccctcatctatggtgcatcccaacacgggccactggcatcccagccaggttcagtggcagtgggtatgggacaggacttcactctcaccatcatcagcctggagcctgaggatgttgctagtttattactgtcaacatcgtaccgagtggcccgtccggggccactttccggcccgtgggaccaaagtggatatacaacgaactgtggctgcaccatctgtcttcta

SEQ ID NO: 782271 - DNA, 511 bp, Homo sapiens
  misc_feature: HIJSMM301BDFBW.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttattcttgtctagcagtctgaagactggccgttcactttcggcggagggaccaaggtggaccttcaaacgaacctgtggctggcaccatactgtcttcatcttcccgcc

SEQ ID NO: 782272 - DNA, 515 bp, Homo sapiens
  misc_feature: HIJSMM301D0LPC.53.21.B10.1.454.light.4.raw
cgcgtatacacacgaccggtgctcgatttagtgtcgtcgcaagagaggaggggggggggtctcaggaggcagcgctctggggacgtctccaccatggcctgggctctgctcctccgcacctcctcactcagggcacaggctcttgggcccagtctgccctgattcagcctccctccgtgtccgggtctcctggacagtcagtcaccatctcctgcactggaaccagcagtgatgttgggggttatgactatgtctccttataacaacaccaaccaggcacagtccaagcccatgctctacaatgtcaattctcggccctcagggggccctgatcgtctctctggctccaagtctgcaatacggcctccatgaccatctctggactccaggctgaggacgatactgattattactcctgctcacaaacaagaagtgccaccttgggtcttcgggcggacgggaccaacctgacccgtcctaggtcagccctaacggctcgcccccgtcggtccgta

SEQ ID NO: 782273 - DNA, 488 bp, Homo sapiens; identical to SEQ ID NO: 535990
  misc_feature: HIJSMM301C6WKE.11.28.C06.1.454.light.4.raw

SEQ ID NO: 782274 - DNA, 496 bp, Homo sapiens
  misc_feature: HIJSMM301ADX3C.2.49.E05.1.454.light.4.raw
  modified_base (441)..(441): a, c, t, g, unknown or other
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggntgggacagcagcctgagtgcttatgtcttggaactgggaccacggtcaccgtcct

SEQ ID NO: 782275 - DNA, 511 bp, Homo sapiens
  misc_feature: HIJSMM301ASCAV.15.59.F04.1.454.light.4.raw
tctacgtagccacgaccggtgctcgatttagtacacacacttagggattgggggaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagcctggtaccaacagaccccaggccagcctccacgcacgctcatctatagcacaaacactcgctcttctggggtcccttgatcgcttctctggctccatccttggaacaaagctgccctcaccatcacggggccaggcagatgatgaatctgtttattattgtgtcctatatatggtgctggcatttcggtcttcggcggagggaccaagctgaccgtctacgg

SEQ ID NO: 782276 - DNA, 488 bp, Homo sapiens
  misc_feature: HIJSMM301EHKF2.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattatacttcgtggtacgttcggccgaaggaccaaggtggatatcagacgaa

SEQ ID NO: 782277 - DNA, 501 bp, Homo sapiens
  misc_feature: HIJSMM301BVA2U.9.53.E09.1.454.light.4.raw
  modified_base (324)..(324): a, c, t, g, unknown or other
tgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctnaggggtttctattcgcttctctggctccaagtctgacaacacggcctccctgacatctctggctccaggctgaggacgaggctgattattactgctgctcatatgcagagtggtgacactcccgtggtattcgggcggagggaccaagggtcgaccgtccgtaggtcaggacccagg

SEQ ID NO: 782278 - DNA, 490 bp, Homo sapiens
  misc_feature: HIJSMM301EVC4F.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcgacagtggatctgggacagagttcactctcaccatcagcagcctgcagcctgatgatcttggaactttattactgccaacaatataaatagttaattggacgtttcggccaggggaccaagggtcgaaaatgaagacgaactgtggctgcaccgat

SEQ ID NO: 782279 - DNA, 504 bp, Homo sapiens
  misc_feature: HIJSMM301C8CSE.19.78.H01.1.454.light.4.raw
  modified_base (497)..(497): a, c, t, g, unknown or other
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagccccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgttcttcggactgggaccaaggtcaccgtctaggtcagcccaaggcccaacccntcgtcta

SEQ ID NO: 782280 - DNA, 506 bp, Homo sapiens
  misc_feature: HIJSMM301BDHMF.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctcgggctccaggctgaggacgaggctgatttattactgcagctcatatacaagcaccagcactctctatgtcttcggaactgggaccaaggtcaccgtcctaggtcagcccaggcccaaccca

SEQ ID NO: 782281 - DNA, 498 bp, Homo sapiens
  misc_feature: HIJSMM301ALZMI.48.85.H08.1.454.light.4.raw
agtatacatacacgaccggtgctcgatttagtatcactcagtcgcgggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggcccaccctcccaaagtcgtatccgacagggataacaatccggcccttagggatctcagagagaatatctgcatccaggtcaaggaaacacagccctccctgaccattactggactccaacctgaggacgaggctgactattattgctcagcagtcgggacaccagcctacaattgccggcggtacttcgggcgcgaagggaccaagctcgaccgtcctaggtcacc

SEQ ID NO: 782282 - DNA, 481 bp, Homo sapiens
  misc_feature: HIJSMM301EMPWA.41.44.D11.1.454.light.4.raw
tctatactatcacgaccggtgctcgatttagcgcagtacgaagggggcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagttttgtggatgaggctgactactattgcacggtctggtacagcagcgcttggtggtcttcgggcggagggactgaacttatcgtctggtcga

SEQ ID NO: 782283 - DNA, 502 bp, Homo sapiens
  misc_feature: HIJSMM301CW3BB.43.44.D11.1.454.light.4.raw
tgtgagtagtcacgaccggtgctcgatttagcgcagtacgaagggggggtcagacccagtcaggacacaacatgcacatgagggtccccgctcagctcctggggctcctgctgctctggctcccaggtgcccaatgtgacatccaggtgacccagtctccttccaccctgtctgcatctgtcggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtaggaaatcaaacgaactgtaggctgcaccatctcgtcttcatcttcccgcctac

SEQ ID NO: 782284 - DNA, 501 bp, Homo sapiens
  misc_feature: HIJSMM301DNYZV.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgctaacttattactgccaacagtatcatcatcattgtaattttcggtggtagggaccgtaagggtaggagggtcaaaccgaacgtagtggctgcaccaatctagtcttc

SEQ ID NO: 782285 - DNA, 501 bp, Homo sapiens
  misc_feature: HIJSMM301BBD73.49.15.B04.1.454.light.4.raw
agtcgagagacacgaccggtgctcgatttagacagtatatatccggcgggggaagagctgctcagttaggacccagagggaaccatggaaaccccagcgcagcttctcttcctcctgctactctggctcccagataccaccggcgaagttgtgttgacgcagtctccaggcaccttgtctctgtctccaggggaaacagccaccctctcctgcagggccagtcagagtgttggcagctattatatagcctggtaccagcagaaacctggccaggctcccaggctcctcatctatggcggatccaacagggccactggcatcccagacaggttcagtggcagtgggtctgggccagacttcactctcacgatcaacagactggagcctgacgatatgggtaatgtattactgcgagcagtttgggaactcaccatggacgttcggccaggggaccaaggtggagatacaaacgaactagtggcgtgcgaccactctgttctt

SEQ ID NO: 782286 - DNA, 502 bp, Homo sapiens
  misc_feature: HIJSMM301DJ7HL.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggaggaccaaactgaacccgtctaggtcagcccaa

SEQ ID NO: 782287 - DNA, 518 bp, Homo sapiens
  misc_feature: HIJSMM301ASZY4.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacgggatccccgatcgcttcatgggctccagttctggggctgaccgctacctcaccatctccaacctccagtctgacgatgaggctgagtatcactgtggagagagccacacaattgatggccaagacggttgggtgttcgggcggagggaccaagctgaccgtccgtaggtcagcccaaggctcgccccctcggtcactctcgttccccaccctccctcgctacgt

SEQ ID NO: 782288 - DNA, 486 bp, Homo sapiens
  misc_feature: HIJSMM301D4HIF.4.10.A10.1.454.light.4.raw
agcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatcgtgggacagtatttcactctcaccatcagcagcctacagcctgaagattttgctaacttattactgtcaacagacttaataattacgcgctctactttcggcggagggaccgaaaggtggagatacaaacgaactagtggctgcaccat

SEQ ID NO: 782289 - DNA, 516 bp, Homo sapiens
  misc_feature: HIJSMM301BJ5X8.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcacgcccaaggctcgccccctcggtcactctcgttcccgccctcctcgctacg

SEQ ID NO: 782290 - DNA, 487 bp, Homo sapiens; identical to SEQ ID NO: 581369
  misc_feature: HIJSMM301DPYYG.7.85.H08.1.454.light.4.raw

SEQ ID NO: 782291 - DNA, 463 bp, Homo sapiens; identical to SEQ ID NO: 737307
  misc_feature: HIJSMM301ED6AA.11.73.G07.1.454.light.4.raw

SEQ ID NO: 782292 - DNA, 453 bp, Homo sapiens
  misc_feature: HIJSMM301AZOS8.19.86.H09.1.454.light.4.raw
tactctcgtgcacgaccggtgctcgatttagtgctatagacttgggtttgggggccgttcctggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 782293 - DNA, 421 bp, Homo sapiens
  misc_feature: HIJSMM301CYTU0.41.53.E09.1.454.light.4.raw
tctatactatcacgaccggtgctcgatttagagagagtgtgttgggtttgggggctttgtctgggtctcctggacagtcgatcaccatctcctgcactggaaccagcagtgacggttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtctaggtcaggcccaaggctgccccctcggtcactctcgttcccaccctcctcatagtataga

SEQ ID NO: 782294 - DNA, 485 bp, Homo sapiens
  misc_feature: HIJSMM301CGSXF.47.60.F05.1.454.light.4.raw
agctcacgtacacgaccggtgctcgatttagtacgtcatcagggaaagggggaggaactgctcagttaggacccagacggaaccatggaagcccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggacacgactggagattaacgaactgtggctgcaccat

SEQ ID NO: 782295 - DNA, 522 bp, Homo sapiens
  misc_feature: HIJSMM301DLRRA.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagccccccaaactgatgatttatgatgtcagtaatcgaccctcgaggggtttctgatcgctttctttgcctccaagtctggcaacacggcctccctgaccatctctgggctccagactgaggacgaggctgattattactgtcagctcacatacaagcggcagcggttgggtgttcgggcggggggaccacactgaccgtcctaggtcagcccaaggctgccccctcgtcactctgttccccg

SEQ ID NO: 782296 - DNA, 484 bp, Homo sapiens; identical to SEQ ID NO: 535240
  misc_feature: HIJSMM301ARWAY.47.60.F05.1.454.light.4.raw

SEQ ID NO: 782297 - DNA, 459 bp, Homo sapiens
  misc_feature: HIJSMM301BASI7.43.66.F11.1.454.light.4.raw
tgtgagtagtcacgaccggtgctcgatttagtcacgcgagaaaggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgacttgggagataaccgaactgtggctgcacatctgtcttcatcttcccgccatctgaactctcaca

SEQ ID NO: 782298 - DNA, 497 bp, Homo sapiens
  misc_feature: HIJSMM301A16HA.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggtattttgcaaacttactactgtcagcaggctaacaggcctcggccccccaaccgttccggccagggggaaccacgacgtggagattaaacgaactgtggctgcacatctgtt

SEQ ID NO: 782299 - DNA, 505 bp, Homo sapiens
  misc_feature: HIJSMM301C1YR8.27.78.H01.1.454.light.4.raw
  modified_base (460)..(460): a, c, t, g, unknown or other
  modified_base (496)..(496): a, c, t, g, unknown or other
agcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttaccncaagtgatcaccttcggccaagggacacgactgganattaaaccg

SEQ ID NO: 782300 - DNA, 509 bp, Homo sapiens
  misc_feature: HIJSMM301AMZ4X.40.9.A09.1.454.light.4.raw
tctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcacttgttttggcgttctccgacttcggcggagggaccgaggtggagtcgaaacgaacgtagtggctgcaccatctgttctctacttccc

SEQ ID NO: 782301 - DNA, 525 bp, Homo sapiens
  misc_feature: HIJSMM301CZQA8.19.59.F04.1.454.light.4.raw
  modified_base (464)..(465): a, c, t, g, unknown or other
tactctcgtgcacgaccggtgctcgatttagtacacacacttagggattgggggcagaaggcaggactcgggacaatcttcatcatgacctgctcccctctcctcctcacccttctcattcactgcacagggtcccgggcccagtctgtgttgacgcagccgccctcagtgtctgcggccccaggacagaaggtcaccatctcctgctctggaagcagctccaacattgggaagaattttgtgtcctggtaccagcagctcccaggaacagccccccaaactcctcattttttgacaataataagcgaccctcagggattcctgaccgattctctggctccaagtctggcacgtcagccaccctgggcatcaccggactccagactggggacggaggccgattattactgcggaacatgggatagcagcctgagtactgtgataatcggcgggagggaccaagnngtaccgtcctaggtcacgcccaaggctcgccccctcggtcactctcgttcccaccctccc

SEQ ID NO: 782302 - DNA, 508 bp, Homo sapiens
  misc_feature: HIJSMM301B5IQB.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatacaaacgaactggtggctgccaccatctgttctctactccttccccgccatctcgactac

SEQ ID NO: 782303 - DNA, 505 bp, Homo sapiens
  misc_feature: HIJSMM301DQF9I.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgtagtctgaagattttgctagtttattactgtcagcagtatgatacctggcctccgtactacgttttggccgggggaccaagctggaaatcgaagcgaactgtggctgcaccatctgtcttcattctcccccg

SEQ ID NO: 782304 - DNA, 503 bp, Homo sapiens
  misc_feature: HIJSMM301EWCRE.15.59.F04.1.454.light.4.raw
  modified_base (502)..(502): a, c, t, g, unknown or other
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcactttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatcttgtttattattgtgtcctatatatgggtgctggctatttcggtctttcggcggaggggaccaagctgaccgtcctaggtcagcccaaggctcgccccctcggtcactctcgttccccgccctcctcgcctacgtana

SEQ ID NO: 782305 - DNA, 499 bp, Homo sapiens
  misc_feature: HIJSMM301CCMW9.11.67.G01.1.454.light.4.raw
  modified_base (204)..(204): a, c, t, g, unknown or other
  modified_base (468)..(468): a, c, t, g, unknown or other
  modified_base (479)..(479): a, c, t, g, unknown or other
cgagagataccacgaccggtgctcgatttagagtatacatattgggtttggggcagcttcaactgtgggttgagaagacaggactcaggacaatctccagcatggtcagcttccctctcctcctcaccctcctcactcactgtgcagggtcctgggcccagtctgttctgactcagccaccctcagcgtctgggacccccgggnagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcgggcggngggaccaagcngaccgtctgggtcagcccaa

SEQ ID NO: 782306 - DNA, 521 bp, Homo sapiens
  misc_feature: HIJSMM301ES455.9.2.A02.1.454.light.4.raw
tgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatcctctggacttcagcctgaggacggagggtgattacttctgcagttcagattcagaaacttccctcgttgggtgttcggcgggaggaccgatgctgaccgtctgagtcacgcccaaggctcgccccctcgtcactctcgttcccgccct

SEQ ID NO: 782307 - DNA, 490 bp, Homo sapiens
  misc_feature: HIJSMM301BZBEA.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagcccaggttcagtggcaggtgggtctgggacagagttcactctcaccatcagcagcctgcagtctgaagtatttgctagtttattactgtcagctactataataactggtcctccgtactagtttcggccgaggggaccaaggctggagatacaaacgaac

SEQ ID NO: 782308 - DNA, 487 bp, Homo sapiens
  misc_feature: HIJSMM301C25GK.40.83.H06.1.454.light.4.raw
tctagcgactcacgaccggtgctcgatttagatcacgtgcgtcgcggggtctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgcacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagccagtgggacggcagcctcagtgaagtgggtgttcggcggtagggaccaaactcgtcgtcctaggtcac

SEQ ID NO: 782309 - DNA, 519 bp, Homo sapiens
  misc_feature: HIJSMM301B0QJ8.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtctgggacagacttcactctcaccatcagcagcctagagcctgaagattttgctagtttattactgtcaacatcgtaccgaggtggccgtccgggggcctaccgttcggccccgtagggaccaaaattgagatacaaacgaacctgtggctgacaccatcttgtcttca

SEQ ID NO: 782310 - DNA, 542 bp, Homo sapiens
  misc_feature: HIJSMM301AH2ND.43.34.D01.1.454.light.4.raw
tgtgagtagtcacgaccggtgctcgatttagatcgtctgtgttggggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttgggagttatagccttgtctcctggtaccaagtgcacccaggcaaagccccaaactcatgatttatgagggcactaagcggcctcgggggtttctgatcgcttctctggctccaagtctggcaacacggcctccctgacaatctctgggctccagggctggaggacgaggctgattattattgctgctcatatgcgaggttagttacaactttatgttacgtttcggaagtttggggaccggacgggttccaccgtacccgttaacggtcgacgccccaaaacgggccccaaacccccacctacg

SEQ ID NO: 782311 - DNA, 502 bp, Homo sapiens
  misc_feature: HIJSMM301EYSKH.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagctttatgttaattcacctccgtcgtacatctttggtccaggggaccaagcgtggagatacaaacgaactgtggctgtcaccatctgttcttcatt

SEQ ID NO: 782312 - DNA, 504 bp, Homo sapiens
  misc_feature: HIJSMM301AK0NQ.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagacaccagcactctctattgtcttcggaactcgggaccaaggtccaccgtcctaggtcacgcccaacgga

SEQ ID NO: 782313 - DNA, 538 bp, Homo sapiens
  misc_feature: HIJSMM301A5VJ6.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgaggggtcccctcgaggttcagtggcagtggatctgggacactatttcaccctcaccatcaatagcctggaagctgaagatgctgcaactttatactgtacatcagtagtaccttactttacctctaagtgactccgtacccttccgggacccaaaggggacctaacggaccgttaggaagtaactttaaaacggaaccttggtaggctgccaacccatcctcgttctta

SEQ ID NO: 782314 - DNA, 496 bp, Homo sapiens
  misc_feature: HIJSMM301D6LV6.46.35.D02.1.454.light.4.raw
  modified_base (196)..(196): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctctcctacagggccagtcactatgttagtgacaactacttagcctggttgcagcacaaacctggccaggctcccaggctcctcatctatgctgcatccatcagggccactggcatcccaggcagattcagtggcagtgggtactggggacaggacttcactctcacccatcagcagactggagcctgaagattttgcagtctattactgtcagcagtatggtcacgtcccaagaacttttggccaggggaccaaagctggagatcaaacgaactgtggctgcaccatctgtt

SEQ ID NO: 782315 - DNA, 493 bp, Homo sapiens
  misc_feature: HIJSMM301DUXRS.41.53.E09.1.454.light.4.raw
  modified_base (461)..(461): a, c, t, g, unknown or other
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtacagtaatcggccctcaggggtttctaatcgcttctctggctccaagtctggcaacacggcctccctgaccatctctgggctccaggctgaggacgaggctgatttatactgcagctcatatacaagcagcagcactctcgtggtattcggnggaggaccaagctgacctcaggtcagccctaa

SEQ ID NO: 782316 - DNA, 383 bp, Homo sapiens; identical to SEQ ID NO: 447524
  misc_feature: HIJSMM301AM67G.41.26.C04.1.454.light.4.raw

SEQ ID NO: 782317 - DNA, 533 bp, Homo sapiens
  misc_feature: HIJSMM301AJAQY.52.30.C08.1.454.light.4.raw
cgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcatgatttatggtgtcggtgaccggccctcaggggtttcgaatcgcttctctggctccaagtccggcaacacggcctccctgaccatctctggcctccaggccgaggacgaggctgattattactgcgcctcatatacaaacaacaacaattgggtgttcggcggagggaccaagctgaccgtcctaggtcagcccaaggctcgccccctcggtcactctcgttcccaccctcctctac

SEQ ID NO: 782318 - DNA, 499 bp, Homo sapiens
  misc_feature: HIJSMM301AMHRS.43.61.F06.1.454.light.4.raw
  modified_base (337)..(337): a, c, t, g, unknown or other
tgtgagtagtcacgaccggtgctcgatttagctacgctctaagggaaaggggagagctctggagaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccanacaggttcagtggcagtgggtctgcgacagacttcactctcattatcagcagactggagcctgaggactttgcagtgtatttctgtcaacataatggtagctcaccgtactacgttttggccaggggaccaagctaagaaatcgaagacgaaacttggtggt

SEQ ID NO: 782319 - DNA, 495 bp, Homo sapiens
  misc_feature: HIJSMM301BU0OH.27.78.H01.1.454.light.4.raw
  modified_base (379)..(379): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagagtactactttacctcaagtgatcaccttcggccaagggacacgactggagattaaacgaactgtggctgcaccatctgtctta

SEQ ID NO: 782320 - DNA, 502 bp, Homo sapiens
  misc_feature: HIJSMM301AGTWP.52.78.H01.1.454.light.4.raw
cgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacggaggctgactattactgtcaatcaacagacagtagtggtacttatgtgcaggttcggcgggagggaccaagctcgaccgtcctaggtcagcccaaggctcgccccctcggt

SEQ ID NO: 782321 - DNA, 483 bp, Homo sapiens
  misc_feature: HIJSMM301ECPLQ.12.8.A08.1.454.light.4.raw
  modified_base (468)..(468): a, c, t, g, unknown or other
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaataccaggcggccctctggggtccctgagcgattctctggctccgactctgggaacacagtcactctgaccatcagcgggacccaggctattgatgaggctgtctactactgtcaggcgtgggcagcagcgtggtgttcggcggagggaccagtctgaccgtcttaggtcagcccaaggcngccccctggtctacc

SEQ ID NO: 782322 - DNA, 510 bp, Homo sapiens
  misc_feature: HIJSMM301D1WTB.43.71.G05.1.454.light.4.raw
  modified_base (467)..(467): a, c, t, g, unknown or other
tgtgagtagtcacgaccggtgctcgatttagtgtcgtcgcaagagagaggggggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggcccactggcatccccagacaggttcagtggcagtgggtctgggacagacttcactctcaccgtcagcagactggaccctgaagtattttgcagtgtattactgtcagcagtatggtagctcaccgatcaccttcggccaagggacacgactaggagattaaccgaactgtggntgcaccactctgtccttctatccttccccgccatctagaacta

SEQ ID NO: 782323 - DNA, 514 bp, Homo sapiens
  misc_feature: HIJSMM301DUGJT.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttccggcccgtcggaccgaaagtggagtatacaaacgaactagtggctgcaccactctgtcttcta

SEQ ID NO: 782324 - DNA, 479 bp, Homo sapiens
  misc_feature: HIJSMM301DP0XI.4.14.B03.1.454.light.4.raw
agcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtgggtcccatcaagattcagcggcagtggatttgggacagaattcactctcaccatcagcagcctgcagcctggtgtattttgctaacttattactgccaacagtataatagttattctctctacttcggcggagggaccgaaggtggagatacaaacgaactaggt

SEQ ID NO: 782325 - DNA, 523 bp, Homo sapiens
  misc_feature: HIJSMM301EZOTS.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccccctcggtcactctcgttcccaccct

SEQ ID NO: 782326 - DNA, 518 bp, Homo sapiens
  misc_feature: HIJSMM301C9OHM.43.9.A09.1.454.light.4.raw
tgtgagtagtcacgaccggtgctcgatttagcgagacgcgcaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgcgtcgggttttcggcgggagggaccaagttgaccgtcctaggtcagcccaaggctcgccccctcggtccactctcgttccccaccctcctcta

SEQ ID NO: 782327 - DNA, 487 bp, Homo sapiens
  misc_feature: HIJSMM301CCNJ3.49.87.H10.1.454.light.4.raw
agtcgagagacacgaccggtgctcgatttagcagtactgcgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccgagggtggagatacaaaacg

SEQ ID NO: 782328 - DNA, 484 bp, Homo sapiens
  misc_feature: HIJSMM301D48IW.46.35.D02.1.454.light.4.raw
  modified_base (397)..(397): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctggacagacttcactctcaccatcagcagactggagcctgaagattttgcngtctattactgtcagcagtatggtcacgtcccaagaacttttgccgaggggaccaaggctggagatcaacgaactgtggctgcacat

SEQ ID NO: 782329 - DNA, 535 bp, Homo sapiens
  misc_feature: HIJSMM301AL9JC.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagttttattactgtcaactagttttctcgggcgttcggtccgaacgggaccgaaagggtaggaaatacgaaaaccgaaactacgtaggtcttcggcaacccactccttgtcctttctactctttccccccg

SEQ ID NO: 782330 - DNA, 501 bp, Homo sapiens
  misc_feature: HIJSMM301AHKFE.5.42.D09.1.454.light.4.raw
atcagacacgcacgaccggtgctcgatttagacacatacgcagggaaagggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcctaccaacattcagcggcagtggatctgggacagagttcactctcacaatcagcagcctgcagcctgatgatcttggaacttattactgccaacaatataattagttattggtacgttcggccgtacggggacggaaggtacggaaagtagagacgaacgtgtaggcgtgcaccactactcgtt

SEQ ID NO: 782331 - DNA, 504 bp, Homo sapiens
  misc_feature: HIJSMM301D7YF1.43.42.D09.1.454.light.4.raw
tgtgagtagtcacgaccggtgctcgatttagacacatacgcagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcaggtgggtctgggacagacttcactctctccatcagcagactggagcctgaagattttgctaatttattactgtcaccagtatggtagctcacctctaactttcggacggtagggacgaaggtggagatacaaacgaacgtgtggctgcaccatctgtcttcta

SEQ ID NO: 782332 - DNA, 490 bp, Homo sapiens; identical to SEQ ID NO: 632786
  misc_feature: HIJSMM301BVXCP.22.73.G07.1.454.light.4.raw

SEQ ID NO: 782333 - DNA, 518 bp, Homo sapiens
  misc_feature: HIJSMM301A79YE.5.24.C02.1.454.light.4.raw
atcagacacgcacgaccggtgctcgatttagtacagatcgttaggggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctcgtgggctccaggctgaggatgaggctgattattactgcagctcatatgcaggcagcagcacgtccccatgtgatcgttcgggcggggggaccaagctcggacccgtctacggtcacgcccacggctcgtccccccg

SEQ ID NO: 782334 - DNA, 500 bp, Homo sapiens
  misc_feature: HIJSMM301CG7QN.22.27.C05.1.454.light.4.raw
  modified_base (433)..(433): a, c, t, g, unknown or other
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatcccggggtccctgaccgattcagtggcagcgggtctgggacagatttcactctcaccatcagcagcctgcaggctgaagatgtggcagtttattactgtcagcaatnttatattcctcctcagacgttcggccaagggaccaaggtaggaatacaaacgaactgtggctgcacc

SEQ ID NO: 782335 - DNA, 530 bp, Homo sapiens
  misc_feature: HIJSMM301D7147.43.23.C01.1.454.light.4.raw
tgtgagtagtcacgaccggtgctcgatttagtacacgtgattagggattggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcggtgggtgttcggcggagggaccaagctgaccgtccgtgggtcacggcccaaggtcgcccccgtccggtctactctcgttcccgtccctccctccacta

SEQ ID NO: 782336 - DNA, 505 bp, Homo sapiens
  misc_feature: HIJSMM301EOKGT.9.27.C05.1.454.light.4.raw
  modified_base (393)..(393): a, c, t, g, unknown or other
tgatacgtctcacgaccggtgctcgatttagacgcgatcgaagggtttggggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctcccaggctcctcatctttgatgcatccactagggccagtggaatcccagacaggttcagtggcaggtgggtctgggacagagttcactctcagcatcaacagcgtgcgggctgaagtntttttgttttttatattgtcagcagtatgataactggcctctgtggacgttcggccaagggaccaaggtggatgtcaaacgaactgtaggctgcaccatctgtcttcattcc

SEQ ID NO: 782337 - DNA, 480 bp, Homo sapiens; identical to SEQ ID NO: 703875
  misc_feature: HIJSMM301AK5JH.16.86.H09.1.454.light.4.raw

SEQ ID NO: 782338 - DNA, 513 bp, Homo sapiens
  misc_feature: HIJSMM301DI86H.8.42.D09.1.454.light.4.raw
  modified_base (410)..(410): a, c, t, g, unknown or other
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaaagccccaaactcatgatttttgaggtcaataagcggccctcaggggtccctgatcgcttctcaggctccaagtctggcaacacggcctccctgaccgtctctgggctccagactgaggatgaggctgatttatatgcagntcatattcaggcagcaacaaggtattcggcggaggacaacggttgaccgtccgtaggtcagcccgaacggctgccccctccggtcctactctcttccctacct

SEQ ID NO: 782339 - DNA, 446 bp, Homo sapiens
  misc_feature: HIJSMM301AI6BP.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttggggtgtttgggtgttcggcggagggaccaagctgaccgtcctaagtcagcccaaggctgccccctcggtcactctgttcccgcccctcctccgtgtctgat

SEQ ID NO: 782340 - DNA, 501 bp, Homo sapiens; identical to SEQ ID NO: 536867
  misc_feature: HIJSMM301AVK48.5.86.H09.1.454.light.4.raw

SEQ ID NO: 782341 - DNA, 515 bp, Homo sapiens
  misc_feature: HIJSMM301CZAN3.48.52.E08.1.454.light.4.raw
  modified_base (505)..(505): a, c, t, g, unknown or other
agtatacatacacgaccggtgctcgatttagtcgagctctctcggcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaacgcccccaaactcatgatttatgatgtcagtaatcggccctcgaggggtttctaatcgcttctctggctccaagtctggcaacacggcctccctgaccatctctgggctccaggctgtggacgaggctgattattactgcacctcatatacaagcagcagcactcttcgtgggttattcgggcggacgggaaccaagctcgaccgtcctaggtccagcccgaaggcncgtccccctc

SEQ ID NO: 782342 - DNA, 510 bp, Homo sapiens
  misc_feature: HIJSMM301EVYGH.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgactaacttattactgccaacagtataagagttatccgtggacgttcggccgaagggaccgagggtaggaaatacgaaacgaaacgtagtggctgcaccatctgttcttcacttccc

SEQ ID NO: 782343 - DNA, 516 bp, Homo sapiens
  misc_feature: HIJSMM301BFL0S.47.83.H06.1.454.light.4.raw
  modified_base (468)..(468): a, c, t, g, unknown or other
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagctggtaccagcaggacccccgggccagactccacgcacgctcatctacaacacagacactcgctcttctggggtccctgatcgcttctctggttccatccttggaacaaagctcgccctcaccatcgcgggggcccaggcagatgatgagtgtgattattactgtgtgctctatagtgggcnggtggtcggtttgggtggttcggcggagggacccaagctgaccgttcg

SEQ ID NO: 782344 - DNA, 494 bp, Homo sapiens
  misc_feature: HIJSMM301CGU4X.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggcgggggaccaagctggaaatcaagacgaactgtggctgcaccatctgttcttctat

SEQ ID NO: 782345 - DNA, 509 bp, Homo sapiens
  misc_feature: HIJSMM301BNFDO.11.57.F02.1.454.light.4.raw
  modified_base (481)..(481): a, c, t, g, unknown or other
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattcctcaccatccgcagcctagagcctgaagtattttgctagtttattactgtcaacagcgtagcagcaggcctccggcgacgttcgcgaaggacaaggtggaagtcaagcgaactgtggntgcaccatctgtcttcatccttcccgcc

SEQ ID NO: 782346 - DNA, 509 bp, Homo sapiens
  misc_feature: HIJSMM301DHHBA.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgtcctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacatacttttgtcttcggaactggaccaaggtcaccgtcctaggtcagccaaggccaacccactgtcactcttccg

SEQ ID NO: 782347 - DNA, 482 bp, Homo sapiens
  misc_feature: HIJSMM301AYL2Y.41.47.E03.1.454.light.4.raw
  modified_base (364)..(364): a, c, t, g, unknown or other
  modified_base (469)..(469): a, c, t, g, unknown or other
tctatactatcacgaccggtgctcgatttagactcgcgcacagagagaaggggtgatcaggactcctcagttcaccttctcacaatgaggctccctgctcagctcctggggctgctaatgctctgggtctctggatctagtggagagattgtgatgagtcagtctccacgctccctgtccgtcaccctggagagtcggcctccatctcctgcaagtcgagtcacaacctcctgtatagtaatggatacaattatgtggattggtacgtgcagaagccagggcagtctccacaactcctcatctatttgggttctcatcgggactccggggtccctgacaggttcactggcagtggatcaggcanagattttaccctagaaaatcagtagagtggaggctgagatgttggcgactattactgcctgcaagctcggcaattcccgatcacctcggcccggcacgactgganataaacgaactgt

SEQ ID NO: 782348 - DNA, 497 bp, Homo sapiens
  misc_feature: HIJSMM301DN1LW.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgctagtttattactgtcagcagtatgatacctggcctccgtactacttttggccgggggaccaagctggaatcaagcgaactgtggctgcaccatctgtcttcattccc

SEQ ID NO: 782349 - DNA, 491 bp, Homo sapiens
  misc_feature: HIJSMM301CAGK9.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagctagcaactggcctctcactttcggcggagggaccaggggtggagatcagacgaactgtggctgcacactctgtt

SEQ ID NO: 782350 - DNA, 493 bp, Homo sapiens
  misc_feature: HIJSMM301EP9GW.10.72.G06.1.454.light.4.raw
catagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactcgcagctcatatacaccaggggcactctcgtgatattcggcggagggacctggctgacccgtcctacgtcacggcccaac

SEQ ID NO: 782351 - DNA, 495 bp, Homo sapiens
  misc_feature: HIJSMM301B6536.4.40.D07.1.454.light.4.raw
agcactgtagcacgaccggtgctcgatttagtgatagagcgtaacaacagagggggagctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaactaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatgggtggggcgcgtcggttttcgggcggggggaccaaggtggacatcaaacgaactgtggctgcaccatctgtt

SEQ ID NO: 782352 - DNA, 458 bp, Homo sapiens
  misc_feature: HIJSMM301AM2Y9.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacgggtccggttttcggcggagggaccaagctgaccgtcctaagtcagcccaaggctgccccctcggtcactctcgttcccgcccctcctccacgagaggta

SEQ ID NO: 782353 - DNA, 486 bp, Homo sapiens
  misc_feature: HIJSMM301DEWI3.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactattattgtcaggcgtgggacagcagcactgcccgttatgtcttcggaactgggaccaaggtcaccgtctgatcagcccaaggccaa

SEQ ID NO: 782354 - DNA, 481 bp, Homo sapiens
  misc_feature: HIJSMM301BRRF0.5.28.C06.1.454.light.4.raw
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaactttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccgaacggtggagatcgaacgaaacctgtgg

SEQ ID NO: 782355 - DNA, 496 bp, Homo sapiens
  misc_feature: HIJSMM301CEDNQ.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgtattttgacaactttattactgaccaacagtatcatcatcattgtaattcggtggagggacaaggtggagtacgaaacgactgtggcttgcaccatctgtcttcattcc

SEQ ID NO: 782356 - DNA, 513 bp, Homo sapiens
  misc_feature: HIJSMM301CRMY8.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggaggactagaactttgctattcggcggagggaccaagttgaccgtcctaagtcaggcccaaggctcgccccctggtcactctgtt

SEQ ID NO: 782357 - DNA, 509 bp, Homo sapiens
  misc_feature: HIJSMM301ASZJI.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtggttcggcggagggaccaagcgtgaccgtcctaagtcagcccaaggctcgccccctcggtcactctcgttcccacctt

SEQ ID NO: 782358 - DNA, 495 bp, Homo sapiens
  misc_feature: HIJSMM301CLXQA.14.3.A03.1.454.light.4.raw
  modified_base (387)..(387): a, c, t, g, unknown or other
  modified_base (473)..(473): a, c, t, g, unknown or other
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagccccaaactcattatttatgaggtcaataatcggccctcaggagtttctaatcgcttctctggctccaagtctggcaacacggcctccctgagcatctctgggctccaggctnaggacgaggctgattattactgcagctcatatactattagcagaactggtggttttcggcggaggaccaaggtgacgtcctagtcngccaggctgcccctcggtcact

SEQ ID NO: 782359 - DNA, 506 bp, Homo sapiens
  misc_feature: HIJSMM301AXY46.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactggggaccaagatcaaccgtcctaggtcagcccaaggcccaacccactgtcta

SEQ ID NO: 782360 - DNA, 500 bp, Homo sapiens
  misc_feature: HIJSMM301DMZOG.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctcaagtctggcaacacggcctcctgacaatctctgggctccaggctgacgacgaggctaattattactgctgctcatatgaaggttataacactatactagttcggcggagggaccaagctgaccgtctgcgtcagcccaaggctgccccctcggtcactc

SEQ ID NO: 782361 - DNA, 490 bp, Homo sapiens
  misc_feature: HIJSMM301C7XPT.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggcctggaccaagtgagatcgaacgaactgtggctgcaccatctgtctt

SEQ ID NO: 782362 - DNA, 491 bp, Homo sapiens
  misc_feature: HIJSMM301BGE4R.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagtggcggtggatctagggcagatttcactctcaccatcaatcacctgcaggctgaggattttgcaacttactactgtcagcaggctaacaggcctgccccccaacttccggccaggggacacggactggagattaaacgaactgtggctgcaccat

SEQ ID NO: 782363 - DNA, 529 bp, Homo sapiens
  misc_feature: HIJSMM301CJDE8.5.27.C05.1.454.light.4.raw
  modified_base (366)..(366): a, c, t, g, unknown or other
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccntcagcagggtcgaaggccggggatggaggccgactattactgtcaggtgtggaatggtggtattatgattatgtcttcggaactgggaccaaggtcaccgtccgtaggttacagcccgaaggcccaaccccactgtcactctcgttcccaccctccctcgtgt

SEQ ID NO: 782364 - DNA, 515 bp, Homo sapiens
  misc_feature: HIJSMM301AX1B4.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaacccccccaactcatcatttatggtgtcactcgtcggccctcaggagtctctcatcgcttctcaggctccaagtctggcaacacggcctccctaaccatctctgggctccagtttgaggacgagtctacttattactgctagtttcctttaaattaggcgccactctcgttggttttcggcggaggcaccgaagtgaccgtctcggtcagccaggctcgcccctcgtcactcg

SEQ ID NO: 782365 - DNA, 509 bp, Homo sapiens
  misc_feature: HIJSMM301CZIHE.43.86.H09.1.454.light.4.raw
tgtgagtagtcacgaccggtgctcgatttagtgctatagacttgggtttggggatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttctacttttggccgaggggacccaaggtggagatcaaacgaactagtggctgcaccatctgtt

SEQ ID NO: 782366 - DNA, 486 bp, Homo sapiens
  misc_feature: HIJSMM301DE9CB.4.27.C05.1.454.light.4.raw
agcactgtagcacgaccggtgctcgatttagacgcgatcgaagggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaatcgggcctccggggtccctgacaggttcagtggcagtggatcaggcacagattttacactgagaatcagcagagtggaggctgaggatggttggggtttactactgcatgcaagctctacaagccacctacacttttggccaggggaccaggctggagatacaaacgaact

SEQ ID NO: 782367 - DNA, 501 bp, Homo sapiens
  misc_feature: HIJSMM301B3QZQ.52.33.C11.1.454.light.4.raw
cgcagtacgacacgaccggtgctcgatttagagtgagctcgttggggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcccggccaggcccctgtcttgcttatttataaagactttgagaggccctcagggacccctgagcgattctctggctccagctcagcgacaacagtcacgttgaccatcagtggagtccaggcaggaggacgaggctgactattactgtcaagtcatcagacagcagtggcacttatgtcggtattcggcggtagggaccaaaactgaccgtcctaggtcagcccaaggcctcgtccccccg

SEQ ID NO: 782368 - DNA, 501 bp, Homo sapiens
  misc_feature: HIJSMM301D1CNN.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagccagaaacctggccaggctcccaggctcctcatctatggtgcatccaccagggccactggtatcccagccaggttcagtggcagtgggtctggggacagagttcactctcaccatcagcagcctgcagtctgaagattttgcggtttattactgtcagcagtataataactggcctccacggtacacttttggccaggggaccaagctggagagtcaaacgactagtggctgcaccatcctgtt

SEQ ID NO: 782369 - DNA, 486 bp, Homo sapiens
  misc_feature: HIJSMM301AKW01.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcagggtccctgaccgattctctggctccaagtctggcacctcagcctccctggtcatcgctgggctccaggctgacgatgaggctgattattattgccagtcctatgacaaccaccctgtcgttggtttttggtctggttcggcggcgggacc

SEQ ID NO: 782370 - DNA, 521 bp, Homo sapiens
  misc_feature: HIJSMM301C4NJN.49.35.D02.1.454.light.4.raw
  modified_base (496)..(496): a, c, t, g, unknown or other
agtcgagagacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcaatatacaaccagcaacaattgggtgttcggcggagggaccaaactgaccgtcctaggtcagacccaaggcngccccctcggtcaactctgttccca

SEQ ID NO: 782371 - DNA, 481 bp, Homo sapiens; identical to SEQ ID NO: 672184
  misc_feature: HIJSMM301BF9BH.22.59.F04.1.454.light.4.raw

SEQ ID NO: 782372 - DNA, 531 bp, Homo sapiens
  misc_feature: HIJSMM301CPL56.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacgttgggtggttcgggcgggcgggaccaaaggtgaccgtcctaagtcacgcccaaggctcgccccctcggtccactctcgttcccaccct

SEQ ID NO: 782373 - DNA, 491 bp, Homo sapiens
  misc_feature: HIJSMM301DGEVM.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttaatgatgcatccaacagggccactggcatcccagccaggttcagtggcagtgggtctgggacagacttcactctcaccatcagcagcctagagcctgaagattttgcagtttattactgtcagcagctagcaactggcctctcaccttcggcggagggaccaaggtggagatcaaacgaactgtggctgcaccatctgtt

SEQ ID NO: 782374 - DNA, 511 bp, Homo sapiens
  misc_feature: HIJSMM301BJQ6V.22.15.B04.1.454.light.4.raw
acatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgccagctcatatggaggcagcgacaattttggtgtttcgggcggagggaccaagctgaccgtcctaggtcagcccaaggctcgccccctcggtctacc

SEQ ID NO: 782375 - DNA, 510 bp, Homo sapiens
  misc_feature: HIJSMM301CMPXT.53.71.G05.1.454.light.4.raw
cgcgtatacacacgaccggtgctcgatttagtgtcgtcgcaagagagaggggcacgaccggtgctcgatttagtgtcgtcgcaagagagagggggctgggcctaaggaagcagcactggtggtgcctcagccatggcctggaccgttctcctcctcggcctcctctctcactgcacaggctctgtgaccctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtctaggtgtgggattttaatagtggatcattgggtgttcggcggagggaccaagctacgg

SEQ ID NO: 782376 - DNA, 503 bp, Homo sapiens
  misc_feature: HIJSMM301DWCJ9.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaattacttttgtcttcggaactgggaccaaggtcaccgtcctaggtcagcccaaggcccaaccccactgtcactcttcgttccccacctccctcgacgtagtaca

SEQ ID NO: 782377 - DNA, 496 bp, Homo sapiens
  misc_feature: HIJSMM301CICS1.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtgggccttcgctcgtccattcggcggagggacccgaaggtgggaggatcaaacgaaa

SEQ ID NO: 782378 - DNA, 483 bp, Homo sapiens; identical to SEQ ID NO: 549135
  misc_feature: HIJSMM301AIDH8.21.25.C03.1.454.light.4.raw

SEQ ID NO: 782379 - DNA, 496 bp, Homo sapiens
  misc_feature: HIJSMM301D23ZA.48.42.D09.1.454.light.4.raw
agtatacatacacgaccggtgctcgatttagacacatacgcagggaaagggggaagagctgctcagttaggacccagagggaaccatggaaaccccagcgcagcttctcttcctcctgctactctggctcccagatagcaccggagaaatcgtgttgacgcagtctccaggcaccctgtctgtgtctccaggggaaagagccaccctctcctgcagggccagtcagagtgttagcagcagctacttagcctggtaccagcagaaaccgggccaggctcccaggctcctcatctatggtgcatccagcagggccacctggcatcccagacaggttcagttgcagtgggtctgggacagacttcactctcaccatcagcagactggagcctgaagattttgctaatttattactgtcagcagtatggtacctcacccaggtacacttttggccgaggggaccaagcgtggagatacaaacgaactgtggctgcaccta

SEQ ID NO: 782380 - DNA, 547 bp, Homo sapiens
  misc_feature: HIJSMM301A2EUW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagattcactctcaccatcagcagcctgcaggctgaagatgtggctagtttattactgtcaactagttttctcggggcgttcggccgtaacggggacccgtaaagggtaggaaaagttacgaaaaccgtaaaccgtaggttagggccgttggccgaacccaactaccttacggttcctttacctaactt

SEQ ID NO: 782381 - DNA, 499 bp, Homo sapiens
  misc_feature: HIJSMM301AMWUH.13.39.D06.1.454.light.4.raw
  modified_base (458)..(458): a, c, t, g, unknown or other
tcacgtactacacgaccggtgctcgatttagtgacatctcgcagttctttggggggctacaacaggcaggcagggggcagcaagatggtgttgcagaccccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttattactgtcagcaatattatatactcctccgaggctcnctttacggcggacggggacaaggtggagtagtacaaacgaa

SEQ ID NO: 782382 - DNA, 472 bp, Homo sapiens
  misc_feature: HIJSMM301AFPZ9.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtgggtcccatcaaggttcagtggcagtggatctgggacagatttcactctaaccatcagcggtctgcaacctgaagattttgcaactcactactgtcaacagagtgacagacaccgcctcactacttcggcgggacgggaccgaaggtggagtatacaaacgaa

SEQ ID NO: 782383 - DNA, 509 bp, Homo sapiens
  misc_feature: HIJSMM301C5Y58.18.59.F04.1.454.light.4.raw
tacgagtatgcacgaccggtgctcgatttagtacacacacttaggggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgccccaaactcatgatttatgatgtcactaatcggccctcaggggtttctaatcgcttctctggctccaagtctggcaacacggcctccctgaccatctctgggctccgaggctgaggacgaggctgattattactgcagctcatatacaagcaccagcactcgtctatgtcttcggaactgggaccaaggtcaccgtcctaggtcaacgccaacggccaaccca

SEQ ID NO: 782384 - DNA, 494 bp, Homo sapiens
  misc_feature: HIJSMM301ESI07.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctccccaaattgctatcatacaggaagaacaacccgcccctcggggactctccgagagattctctgcatcaacgtcaggaaacatagcctccctgaccattactggactccagcctgaggacgaggctgactattactgctcagcatgggacagcagcctctaatggtttgggtggttcggcggagggaccaagcgtgaccgtcctaggtcacg

SEQ ID NO: 782385 - DNA, 490 bp, Homo sapiens
  misc_feature: HIJSMM301ENH23.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatcggtcacgtcccaagtaacttttggcctaggggaccaagctgagatacaaacgaactgtggctgacaccat

SEQ ID NO: 782386 - DNA, 500 bp, Homo sapiens
  misc_feature: HIJSMM301A9V5K.22.38.D05.1.454.light.4.raw
  modified_base (477)..(477): a, c, t, g, unknown or other
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggccctccgtacacctttggccgagggaccaagctggagatcaaacgaacngtggctgcaccatctgtcttcat

SEQ ID NO: 782387 - DNA, 488 bp, Homo sapiens
  misc_feature: HIJSMM301AULTI.40.83.H06.1.454.light.4.raw
tctagcgactcacgaccggtgctcgatttagatcacgtgcgtcgcggggtctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcagtgggacggcagcctcagtgaagtgggtgttcggcggaggaccaaacgtgtccgtccgtaggtcacg

SEQ ID NO: 782388 - DNA, 465 bp, Homo sapiens
  misc_feature: HIJSMM301DGCGG.11.86.H09.1.454.light.4.raw
cgagagataccacgaccggtgctcgatttagtgctatagacttggggtttgggggccgttcctgggcccagtctgtgctgactcagccaccctcagcgtctgggacccccgggcagagggtcatcatctcttgttctggaagcagctctaatatcggaagtaatactagtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaagtcagcccaaggctcgccccctcggtcactctcgttcccaccctcctcgtactctctcg

SEQ ID NO: 782389 - DNA, 305 bp, Homo sapiens; identical to SEQ ID NO: 544328
  misc_feature: HIJSMM301B9XFZ.49.19.B08.1.454.light.4.raw

SEQ ID NO: 782390 - DNA, 486 bp, Homo sapiens
  misc_feature: HIJSMM301AREAD.49.73.G07.1.454.light.4.raw
agtcgagagacacgaccggtgctcgatttagctctacgctcagggcacgaccggtgctcgatttagctctacgctcagggcacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctctggtgcatccagtagggccactggcatcccagacaggttcagtggcagtgggtctgggacagacttcactctcaccatcagtagactggagcctagaagatttcgcagtgtattactgtcagcaattcaat

SEQ ID NO: 782391 - DNA, 507 bp, Homo sapiens
  misc_feature: HIJSMM301BKMUR.8.28.C06.1.454.light.4.raw
ctcgcgtgtccacgaccggtgctcgatttagagctcacgtattgggtttgggggggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcgggagggaccgaaggtggacctcaaacgaactgtggctgcaccatctgtcttcatctcccgccat

SEQ ID NO: 782392 - DNA, 501 bp, Homo sapiens
  misc_feature: HIJSMM301AL8PG.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagccgtgaagtagtttttgctagtctattactgtcagcagtatggtcacgtcccaagtacttttggccgagggaccaagctggagataccaaacgaactgtggactcgacaccatcttcg

SEQ ID NO: 782393 - DNA, 492 bp, Homo sapiens; identical to SEQ ID NO: 615492
  misc_feature: HIJSMM301A2CAS.47.78.H01.1.454.light.4.raw

SEQ ID NO: 782394 - DNA, 379 bp, Homo sapiens
  misc_feature: HIJSMM301AWT3A.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgcttcttttactgggcgtcgttcccgggagtccggggtccctgaccgattcagtgccagcgggtctgggacagacttcactctcacca

SEQ ID NO: 782395 - DNA, 522 bp, Homo sapiens
  misc_feature: HIJSMM301A0RJT.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaaggtttccaaccgggactctggggtcccagacagattcagcggcagtgggtcaggcactgatttcacactggaaatcagcagggtggaggctgaggatggttggggtttattactgcatgcaaaactacacaacggccgcgtcactttcgcggtacgggacggaaggtaggaggagtacaaacgaaactacgttggctggcacactatgtt

SEQ ID NO: 782396 - DNA, 452 bp, Homo sapiens
  misc_feature: HIJSMM301A1B95.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggaggacaagctgaccgtcctaagtcagcccaagctcgccccctcggtcactctgttcccgccctcctccacgagtgta

SEQ ID NO: 782397 - DNA, 507 bp, Homo sapiens
  misc_feature: HIJSMM301ER6Z2.43.86.H09.1.454.light.4.raw
  modified_base (495)..(495): a, c, t, g, unknown or other
tgtgagtagtcacgaccggtgctcgatttagtgctatagacttgggtttgggggatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttagttactgcatgcaaacttcactactggcctccgtctacttttggccaggggaccaaggtggagatcaaacgaactgtggntgcacatctgtt

SEQ ID NO: 782398 - DNA, 490 bp, Homo sapiens
  misc_feature: HIJSMM301APBMI.22.65.F10.1.454.light.4.raw
  modified_base (480)..(480): a, c, t, g, unknown or other
acatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtgggtcccgtcaaggttcagtggcagtggatctgggacagatttcactctcaccatccgcggtctgcaacctgaagatttcgcaacttactactgtcaaacagacttacagtcgccccccgatccaccttcggccaagggacacacgtagagataaacgtaactagtgctgcacnctactgtctt

SEQ ID NO: 782399 - DNA, 495 bp, Homo sapiens
  misc_feature: HIJSMM301BT3T6.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatgggtgcatccactttgcatagtggggtcccatcaaggttcagcggcagtggatctgggacagaattcactctcacaatcaccagcctgcagcctggaagtattttgctaacttattactgtcaactaggttttataattttaccctacgttacgttttccggccctgggaccacagtaagattatacaaacgaactgtggctgcacc

SEQ ID NO: 782400 - DNA, 522 bp, Homo sapiens
  misc_feature: HIJSMM301C88MR.5.58.F03.1.454.light.4.raw
atcagacacgcacgaccggtgctcgatttagtctgatcgagaaggggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcactacttttatggttcgggacgttcgggaccaaggtcaccgtcctaggtcacgcccaacggcccaaccccactcgtcactcttccg

SEQ ID NO: 782401 - DNA, 506 bp, Homo sapiens
  misc_feature: HIJSMM301B285L.7.71.G05.1.454.light.4.raw
  modified_base (490)..(490): a, c, t, g, unknown or other
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaacgtaggatatcaacgaactgtggntgcaccatctcgtctt

SEQ ID NO: 782402 - DNA, 491 bp, Homo sapiens
  misc_feature: HIJSMM301D9209.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagtcggcagtggatctgggacagatttcactctcgccatcagcagcctgcagactgaagattttgcaacttattttgtcaacaggctaacacctttcccctcactttcggcggagggacgaacggtggagatcaagcgaactgtgctgcacatctgtctta

SEQ ID NO: 782403 - DNA, 523 bp, Homo sapiens
  misc_feature: HIJSMM301ASWOJ.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggcccaacccccacgtcgtcactctgttccccaccctccctccgt

SEQ ID NO: 782404 - DNA, 510 bp, Homo sapiens
  misc_feature: HIJSMM301AQBU8.19.67.G01.1.454.light.4.raw
tactctcgtgcacgaccggtgctcgatttagagtatacatattgggtttgggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagcctcctccaactctgcctccctcaccatctctggactgaagactgagggacgaggctgactactactgtcagtcttaatgatagccgcggtcatgtggtcttcggcggagggacagctcgaccgtcgtacggtcacgcccgaaggctcgccccctcc

SEQ ID NO: 782405 - DNA, 523 bp, Homo sapiens
  misc_feature: HIJSMM301BNOE3.9.86.H09.1.454.light.4.raw
tgatacgtctcacgaccggtgctcgatttagtgctatagacttgggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcacgcccaaggctcgccccctcggtcactctgttccccaccctcctc

SEQ ID NO: 782406 - DNA, 493 bp, Homo sapiens
  misc_feature: HIJSMM301BSI81.3.10.A10.1.454.light.4.raw
agacgcactccacgaccggtgctcgatttagcgtcgatctcagggggctgtgggtccaggaggcagaactctgggtgtctcaccatggcctggatccctctacttctcccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgcaatcagcagacaacagtaatactttaatcttttatgtcttggatctgggaccagggtcaccgtcctaggtcagcccaaggcctaaccccc

SEQ ID NO: 782407 - DNA, 507 bp, Homo sapiens
  misc_feature: HIJSMM301AYJAW.4.10.A10.1.454.light.4.raw
agcactgtagcacgaccggtgctcgatttagcgtcgatctcaggggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatggatgacatcctacgtggtgcggtgttcggcggagggaccaagttgaccgtcctgggtcagccaagctgccccctcggtcactctcgttcccta

SEQ ID NO: 782408 - DNA, 508 bp, Homo sapiens
  misc_feature: HIJSMM301D9TC3.21.22.B11.1.454.light.4.raw
  modified_base (420)..(420): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccaagaggaataatcagcggccctcaggggtccctgaccgattctctggctccaagtctggcacctcagcctccctgaccatcagtgggctccggtccgaggatgaggctgactattactgtgcntcacgggacgcaacatggggatggacaatctgagtcgggttgggtgttcggcgggagggacccaaaactcgaccgtcctaaggtccag

SEQ ID NO: 782409 - DNA, 506 bp, Homo sapiens
  misc_feature: HIJSMM301ENDLP.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcagtcttcggaactgggaccaaggtcaccgtcctaggtcagcccaaggccaaccccactgtcta

SEQ ID NO: 782410 - DNA, 499 bp, Homo sapiens
  misc_feature: HIJSMM301BH7YH.48.78.H01.1.454.light.4.raw
agtatacatacacgaccggtgctcgatttagtgtgagtagtttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactcttgactatcagtgaagtccggacagaagacgaggctgactactattgtcagtcaggagacaatactcgcacgcaagtactgttcgggcgggacgggaaccaagctgacagtcctaggtacagcccaaggctcgccccctc

SEQ ID NO: 782411 - DNA, 509 bp, Homo sapiens
  misc_feature: HIJSMM301EP2FB.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggggcagagggtcaccatatcttgttctggaaacagctccggcatctcaactaaacatttttgctggtaccagcaattcccaggatccggccccccgactcctcatctatagaatgatcatcggccctccggggtccctgaccgattctctggctccatgtctggcacctcacgcctccctgaccatcagtgggctccggtccgaggatgaggctgattattactgtgcaccgtgggatgacatcctgaatggtccggtgttcggcggagggaccaggctgaccgtcctaatcagccaaggctgccccctc

SEQ ID NO: 782412 - DNA, 502 bp, Homo sapiens
  misc_feature: HIJSMM301D7RCR.9.12.B01.1.454.light.4.raw
  modified_base (430)..(430): a, c, t, g, unknown or other
  modified_base (477)..(477): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcaggcgggtctgggacagatttcactctcaccatcagcagcctgcaggctgaagatgtggcagttttatactgtcaactagtttcncgggcgtcgccgaacgggaccaaggtaggaatacaaacgatagtggntcgcacatctgtcttcatcttcccc

SEQ ID NO: 782413 - DNA, 528 bp, Homo sapiens
  misc_feature: HIJSMM301BC1LG.8.42.D09.1.454.light.4.raw
ctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggccctcctgaccgtctctgggctccagactgaggatgaggctgattattactgcagctcatattcaggcagcaacagggtattcgggcggaagggaccaagttcgaccgttccgtaaggtcacgcccaaggtcctggcccccctggtcctactctcgttccccacccttcccg

SEQ ID NO: 782414 - DNA, 495 bp, Homo sapiens; identical to SEQ ID NO: 538269
  misc_feature: HIJSMM301B7W53.9.1.A01.1.454.light.4.raw

SEQ ID NO: 782415 - DNA, 475 bp, Homo sapiens
  misc_feature: HIJSMM301B5IOX.22.6.A06.1.454.light.4.raw
  modified_base (438)..(438): a, c, t, g, unknown or other
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgaccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattatgtcaatcaacagacagtagtgggaaatatgtggtattcggnggagggaccaaactgacgtcctaggtcagcccaggct

SEQ ID NO: 782416 - DNA, 500 bp, Homo sapiens
  misc_feature: HIJSMM301D0L5Z.26.78.H01.1.454.light.4.raw
agactatactcacgaccggtgctcgatttagtgtgagtagtttggggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgctactttattactgtcagcagcgtagcaactggcctctctacgtttcggcggaggggccgaggggtggagatcagacaacgtgtggctggctaccatctgtt

SEQ ID NO: 782417 - DNA, 528 bp, Homo sapiens
  misc_feature: HIJSMM301EFTND.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctcccggcctccaggcggaggacgagggtgattatttctgcagctcatttacaaccagccacaccttgctcttcggaactgggaccacggtcattcgtcctacggtcagcccaaggacccaacccccactcgtcactctcgttcccgccctcct

SEQ ID NO: 782418 - DNA, 454 bp, Homo sapiens
  misc_feature: HIJSMM301BGK46.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctggatgacagtgtgaacggtccggtttcggcggagggaccaagctgaccgtcctaagtcagcccaaggctgccccctcggtcactctcgttcccgccctcctccacgagacgta

SEQ ID NO: 782419 - DNA, 506 bp, Homo sapiens
  misc_feature: HIJSMM301EU1ET.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctcgaccgattcagtggcaggcgggtctgggacagtatttcactctcaccatcagcagcctgcaggctgaagatgtggcagttttattactgtcagcaatattatagtactcctccgaggcctcaccgtttcggcggtagggaaccgaaggtcggagatacaaacgaact

SEQ ID NO: 782420 - DNA, 520 bp, Homo sapiens
  misc_feature: HIJSMM301ADIWD.22.36.D03.1.454.light.4.raw
acatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggcgagtctacttattactgcagttcctttaaattaggcgccactctcgtggttttcggcggaggcaccgaagtgaccgtcctcggtcagcccaaggcctgccccctcggtcactcttaccg

SEQ ID NO: 782421 - DNA, 508 bp, Homo sapiens
  misc_feature: HIJSMM301D1ZKK.18.59.F04.1.454.light.4.raw
  modified_base (456)..(456): a, c, t, g, unknown or other
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaaatcgcttctctggctccaagtctggcaacacggcctccctgaccatctctgggctccaggcctggaggacgaggctgattattactgcagctcatatacaagcaaccagcactctctatgtnttcggaactgggaccaaggtcaccgtctaggtcagcccaaggcccaacccca

SEQ ID NO: 782422 - DNA, 506 bp, Homo sapiens
  misc_feature: HIJSMM301A58NI.17.57.F02.1.454.light.4.raw
cgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaacttttttaaattggtatcagcgggaaccagggaaagccccctaaactcctgatctatactgcatccaatttgcaaagtggggtcccatcaaggttcagtggcagtggatctgggacagatttcacttctcaccatcagcagtctgcaacctgaggattttgcaacttactactcgtcaacagggttacgacgtaaccccggtactaacttttgggaccacggggaccgaagactggagatacaaacgaactgtggctggcaccata

SEQ ID NO: 782423 - DNA, 495 bp, Homo sapiens
  misc_feature: HIJSMM301BEN17.43.55.E11.1.454.light.4.raw
  modified_base (417)..(417): a, c, t, g, unknown or other
  modified_base (422)..(422): a, c, t, g, unknown or other
  modified_base (484)..(484): a, c, t, g, unknown or other
tgtgagtagtcacgaccggtgctcgatttagcactcgcacgttgggtttggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatntattnttggtccgtggacgtcgccgaggacgacgaggtaatacaacgaactagtaggctgcaccacnctatctctact

SEQ ID NO: 782424 - DNA, 494 bp, Homo sapiens
  misc_feature: HIJSMM301D111T.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcactcccagccaggttcagtggcagtgagtctgggacagacttcactctcaccatcagcagcctagagcctgaagattttgctactttattactgtcagcagcgtagcaactggcctctcactttcggcggagggaccagggtggagatcagacgaactgtaggctgcaccatctgtt

SEQ ID NO: 782425 - DNA, 493 bp, Homo sapiens
  misc_feature: HIJSMM301BC7LH.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctcatgcaaggtacacactggccttttggccacggggaccaacctggagatacaaatgaactgtggctgcacatctgtctt

SEQ ID NO: 782426 - DNA, 492 bp, Homo sapiens
  misc_feature: HIJSMM301DT5M2.13.67.G01.1.454.light.4.raw
  modified_base (309)..(309): a, c, t, g, unknown or other
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttacngggcatctatccgggaatccggggtccctgaccgattcagtggcagcgggtctgggacagatttcactctcaccatcagcagcctgcagctgaagatgtggcagtttattactgtcagcaactattatagtactcctccgaggctcactttcggcggtagggaccaggtgagatcaaacgact

SEQ ID NO: 782427 - DNA, 579 bp, Homo sapiens
  misc_feature: HIJSMM301EUB7O.41.19.B08.1.454.light.4.raw
  modified_base (566)..(566): a, c, t, g, unknown or other
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacacccttgcctccgttacggaacgtcgggacccacgggtaccacgttccgtccgttaaggtccacggacccccgaaagggacccccaaacccccctaaccgttacgtccaccttccgttccggtttcccccncccccttccctta

SEQ ID NO: 782428 - DNA, 516 bp, Homo sapiens
  misc_feature: HIJSMM301C8JN7.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaatggagtcccatcaagattcagcggcagtggatctggcacagctttcactctcaccgtcagtcagcctgcagtctgaagatttgctaacttattactgtctacaagattcttcttacccctcggtaccggttcggtaccgtacggggaaccgtaccgggtacggtagtgtcgtaagaccggtaacgtacggtgggcgtcgtacacccg

SEQ ID NO: 782429 - DNA, 491 bp, Homo sapiens
  misc_feature: HIJSMM301AZIS9.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagtattttacactagaaaatcagcagagtggaggctgaggatgttgggctctattattgctatgacaagctactacaagtcccgctctcttcggcggagggtaccgaaggtggagatacaaacgaa

SEQ ID NO: 782430 - DNA, 514 bp, Homo sapiens
  misc_feature: HIJSMM301B1YGI.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncggggcgttcggacctaacgggaccgaaggtaggaaagtacaaacgaactggtggctgcaccatctgtcttctatccttccccg

SEQ ID NO: 782431 - DNA, 446 bp, Homo sapiens; identical to SEQ ID NO: 759763
  misc_feature: HIJSMM301A3N83.8.73.G07.1.454.light.4.raw

SEQ ID NO: 782432 - DNA, 500 bp, Homo sapiens
  misc_feature: HIJSMM301B9PFS.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagacccaaggcccaaccc

SEQ ID NO: 782433 - DNA, 511 bp, Homo sapiens
  misc_feature: HIJSMM301AHTSJ.47.55.E11.1.454.light.4.raw
  modified_base (413)..(413): a, c, t, g, unknown or other
  modified_base (464)..(464): a, c, t, g, unknown or other
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaaccggcccccaaactcctcatctataacaatgatcagcggccctcaggggtccctggccgattctctggctccaagtctggcgcctcagcccaccctggccatcagtgggctccggcccgaggatgaggcngattattactgtgtaggttgggatcgcagcctgactgcttacgtcttcggngctgggaccaggtcaccgtcctaggtcacgccaacggccaaccccca

SEQ ID NO: 782434 - DNA, 380 bp, Homo sapiens
  misc_feature: HIJSMM301EEZZF.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaaacctcctaagttgctcttttactgggcgtcttcccgggagtccggggtccctgaccgattcagtgccagcgggtctgggacagacttcacttctcacca

SEQ ID NO: 782435 - DNA, 512 bp, Homo sapiens
  misc_feature: HIJSMM301AR3E2.18.78.H01.1.454.light.4.raw
  modified_base (238)..(238): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggnggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgatttattactgcacgctccaatataacaagcagcagcactcaatcttcggaactgggaccaaggtcaccgtcctaggtcagcccaaggcccaaccccactgtcta

SEQ ID NO: 782436 - DNA, 522 bp, Homo sapiens
  misc_feature: HIJSMM301E2D65.43.9.A09.1.454.light.4.raw
  modified_base (280)..(280): a, c, t, g, unknown or other
tgtgagtagtcacgaccggtgctcgatttagcgagacgcgcaggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccgganactgatttatgatacaagcaaacaaactttcctggacacctgcccgattctcaggctccctccttgggggcaaagctgccctgaccctttcgggtgcgcagcctgaggatggaggctgactattactgcttgctcgcctatgatgctgcgtcgggttttcgggcggagggaccaagttggaaccgtccgtaggttcagcccaaggctcgccccctcggtcactctgttcccgccctcctcta

SEQ ID NO: 782437 - DNA, 497 bp, Homo sapiens
  misc_feature: HIJSMM301EUROP.16.68.G02.1.454.light.4.raw
  modified_base (479)..(479): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgctaacttattactgccaacagtatcatcatcattgtaatttcggtggagggaccaagggtggaggtcgaaacgaactggtggctgnaccatctgtcttcattcc

SEQ ID NO: 782438 - DNA, 520 bp, Homo sapiens
  misc_feature: HIJSMM301C3EDN.17.87.H10.1.454.light.4.raw
cgtagactagcacgaccggtgctcgatttagcagtactgcgttgggtttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttccgctggctccacgtctggcagcacggcctccctgaccaatctctgggctccaggctgaggacgaggctgattattactgctgctcatattcaagtcgtgtcactatgatttttggcggtaggcaccgaaggtgaccgtcctaaggtcagcccaaggtcgtcgccccctcggttccaccg

SEQ ID NO: 782439 - DNA, 491 bp, Homo sapiens
  misc_feature: HIJSMM301A0ZG2.11.28.C06.1.454.light.4.raw
  modified_base (394)..(394): a, c, t, g, unknown or other
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcaggtgggtcaggcgctgatttcacactgagaatcagcagggnggaggctgaagatgtcggggtttattactgcatgcagggtacagtgtggccttcgctcgcagttcggcggagggaccgaaggtggagatcaaacgaa

SEQ ID NO: 782440 - DNA, 494 bp, Homo sapiens
  misc_feature: HIJSMM301AJL01.49.3.A03.1.454.light.4.raw
agtcgagagacacgaccggtgctcgatttagagagcgtcacagggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctccaggctcctcatctatgatgtgtctaccagggccactggtatcccagccaggttcagtggcagtgggtctggggcggagttcactctcaccatcagcagcctgcagtctgaagtattttgctagtttattacttgtcagcactctaatgactcggcccctgtactactttcgggcccggggaccaaggtggagatacaaacgaactggtggctgcaccatctgtt

SEQ ID NO: 782441 - DNA, 508 bp, Homo sapiens
  misc_feature: HIJSMM301B374Z.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccattttcttgttctggaacccactccaacatcggatataattctgtagactggtaccagcagtttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaaggctggaccgtcctaggtccagcccaagg

SEQ ID NO: 782442 - DNA, 515 bp, Homo sapiens
  misc_feature: HIJSMM301AYNOO.53.20.B09.1.454.light.4.raw
cgcgtatacacacgaccggtgctcgatttagtgtagtgtgaagggggggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccaccctgaccatcagcagggtcgaagccggggacgaggccgactattactgtcaggtgtgggtattttaatagtgatcagttggggtgttcgggcggagggaccaagctgaccgtcctaggtcagcccaaggctcgccccctcggtccactctcgttcccgccctcct

SEQ ID NO: 782443 - DNA, 497 bp, Homo sapiens; identical to SEQ ID NO: 694715
  misc_feature: HIJSMM301A6I9Z.22.14.B03.1.454.light.4.raw

SEQ ID NO: 782444 - DNA, 519 bp, Homo sapiens
  misc_feature: HIJSMM301CS9MS.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgagggctgattattactgtccactcatatagaagtagtactactcctgtggttttcggcggtagggaccgaagctgaccgtcctaggtcagcccaaggctgccccctcggtccactctgttccccg

SEQ ID NO: 782445 - DNA, 516 bp, Homo sapiens
  misc_feature: HIJSMM301DS8ZA.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccgttggggcaaagctgccctgacactgtctggtgtgcagcctgaggacgaggctgactattactgcctactctactttggtggtgctgtgctattcggcggagggaccaagctgaccgtcttaagtcagcccaaggcctcgcccccgtcggtcacttctcgttcccta

SEQ ID NO: 782446 - DNA, 520 bp, Homo sapiens
  misc_feature: HIJSMM301AGN7M.51.38.D05.1.454.light.4.raw
cgatcgtatacacgaccggtgctcgatttagtatctgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgtattattactgcagctcatatacaatcaataacaattgggtgttcggcggagggaccaacgtacgaccgtccctaggtcacgcccgaagctcgccccctcggtcactcttcg

SEQ ID NO: 782447 - DNA, 525 bp, Homo sapiens
  misc_feature: HIJSMM301BBREH.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatcctccgggctccagcctgaggacgaggctgattattattgtagttcatatacaaccagtagacacttgggtgttcggcggagggaccaggctgaccgtcctaggtcagccaaggctcgccccctcggtcactctcgttcccaccct

SEQ ID NO: 782448 - DNA, 529 bp, Homo sapiens
  misc_feature: HIJSMM301CLHD7.22.36.D03.1.454.light.4.raw
acatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaacccccccaactccatcatttatggtgtcactcgtcggccctcaggagtctctcatcgcttctcaggctccaagtctggcaacacggcctccctaaccatctctgggctccagtttgaggacgagtctacttattactgctagttacctttaaattaggcgccactctcgtggttttcggcggaggtaccgaagtgaccgtcctcggtcagcccaaggctcgccccctcggtcactctcgttccccg

SEQ ID NO: 782449 - DNA, 505 bp, Homo sapiens
  misc_feature: HIJSMM301AKUYH.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgctagtttattactgtcagcagcgtagcaactggcctcggttcacttttggccaggggaccaagctggagatacaaacgaactgtggctgcaccatctgtcttcattccc

SEQ ID NO: 782450 - DNA, 512 bp, Homo sapiens
  misc_feature: HIJSMM301EIBMW.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacgagggaggcgtggcgtagttttcgggcgggagggatcgagtctgaccgtcctaggtcagtcccaaggcctcgcccccctcggtccacttccg

SEQ ID NO: 782451 - DNA, 487 bp, Homo sapiens; identical to SEQ ID NO: 689360
  misc_feature: HIJSMM301DC187.3.12.B01.1.454.light.4.raw

SEQ ID NO: 782452 - DNA, 497 bp, Homo sapiens
  misc_feature: HIJSMM301B6Z4I.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttacaaaataccaggcggccctctcggggtccctgagcgattctctggctccgactctgggaacacagtcactctgaccatcagcgggacccaggctattgatgaggctgtctactactgtcaggcgtgggacagcagcgtggtggttcggcggagggaccagtctcggaccgtcgttaggtcacgcccgaaggcctcgccccctcggtcctacc

SEQ ID NO: 782453 - DNA, 502 bp, Homo sapiens
  misc_feature: HIJSMM301CL6VZ.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaactttcccgctcactttcggcggagggaccaaggtggagatcaaacgaactgtggctgcacatctgtcttcatcttccccg

SEQ ID NO: 782454 - DNA, 506 bp, Homo sapiens
  misc_feature: HIJSMM301BGIV3.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaacgtggagtatcaaacgaactgtggctgcacatctgtt

SEQ ID NO: 782455 - DNA, 472 bp, Homo sapiens
  misc_feature: HIJSMM301A5J55.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatctactttcggccctggactgaagtgcatatgaagagaactgtggc

SEQ ID NO: 782456 - DNA, 489 bp, Homo sapiens
  misc_feature: HIJSMM301ADXDF.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtcctccactctccctgcccgtcacccctggagagccggcctccatctcctgcaggtctagtcagagcctcctgcatagtaatggatacaactatttggattggtacctgcagaagccagggcagtctccacagctcctgatctatttggttctaatcgggcctccgggtccctgacaggttcagtggcagtggatcaggcacagattttacactgaaaatcagcagagtggaggctggaggatggtttgggtttattactgcatgcaagctctacaactccttactacttttggccaggggaccaagctggagatcaaacgaat

SEQ ID NO: 782457 - DNA, 508 bp, Homo sapiens
  misc_feature: HIJSMM301ERZ58.5.24.C02.1.454.light.4.raw
  modified_base (407)..(407): a, c, t, g, unknown or other
  modified_base (488)..(488): a, c, t, g, unknown or other
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccagtctggcaacacggcctccctgaccgtctctgggctccaggctgaggatgaggctgnttattactgcagctcatatgcaggcagcagcagtcccatcgtgatcttcggcgggggaccgaagctgaccgtctacggtancgccaaggctcgtccccccg

SEQ ID NO: 782458 - DNA, 445 bp, Homo sapiens
  misc_feature: HIJSMM301BFGB2.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatggtggtattcggcggagggacccacgtaaccgtcctaggtcagcccaaggctcgccccctcggtccactcctgttcccgccctcctcgtatctctcg

SEQ ID NO: 782459 - DNA, 490 bp, Homo sapiens
  misc_feature: HIJSMM301D3UO8.5.45.E01.1.454.light.4.raw
atcagacacgcacgaccggtgctcgatttagtgagtcagtaagggaaagggggagtcagacccagtcaggacacagcatggacatgagggtccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattaatgacaacttactattgtacaaagttctaatgctttcccgcgcacgtttggccaggggaccaaaggtagaggatcaaacgaactagtggctggcaccat

SEQ ID NO: 782460 - DNA, 490 bp, Homo sapiens
  misc_feature: HIJSMM301DUKJA.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtacaacaatattattatacttcgtggacgttcggaccaagggaccaaggtggatatcagacgaa

SEQ ID NO: 782461 - DNA, 495 bp, Homo sapiens
  misc_feature: HIJSMM301AN90E.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctcagctctgggacgacactcactctgactatcagtgaagtcgggcagaagacgaggctgactactattgtcagtcaggagacaatactcgcacgacaagtactgttcggacggagggaccaagctagacagtcctaggtcagcccaaggctcgtccccccg

SEQ ID NO: 782462 - DNA, 422 bp, Homo sapiens
  misc_feature: HIJSMM301DAYIK.18.59.F04.1.454.light.4.raw
tacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaaccccactcgtcactctcgttcccgccctcctccatactcgta

SEQ ID NO: 782463 - DNA, 485 bp, Homo sapiens
  misc_feature: HIJSMM301CXSDT.43.76.G10.1.454.light.4.raw
tgtgagtagtcacgaccggtgctcgatttagtcactcatacaggggggcgggggtaagaggttgtgtccaccatggcctggactcctctcctcctcctgttcctctctcactgcacaggttccctctcgcaggctgtgctgactcagccgtcttccctctctgcatctcctggagcatcagccagtctcacctgcaccttgcgcagtggcatcaatgttgctacccacacaatatactggtaccagcagaagtcagggagtcctccccagtttctcctgaggtacaaatcagactcagataagcagcagggctctggaactccccagccgtttctctggatccaaggatgcttcggcaatgcaggtatttgctcatctctggctccagtctgaggatgaggctgactattactgtacgagtttggcacaacgacgctgttggttttcggcggagggaccaagctcgaccgtcctaagtcgacgcc

SEQ ID NO: 782464 - DNA, 507 bp, Homo sapiens
  misc_feature: HIJSMM301DSMKJ.48.26.C04.1.454.light.4.raw
agtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacgacggcctccctgaccgtctctgggctccaggctgaggatggaggctgattattactgcagctcatatgcaggcagcaacaatgtggtattcggcggagggaccaagctgaccgtcctaggtcagcccaaggctcgccccctcggt

SEQ ID NO: 782465 - DNA, 506 bp, Homo sapiens
  misc_feature: HIJSMM301DPBG2.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacattggtacaggcagaagccaggccaggccctgtggtggtcgtccgttatgatagcgaccggccctcagggatccctgagcgattctctggctccaactctgggaacacggccaccctgaccatcagcagggtcgaagccgggatgaggccgactagttactgtcaggtgtgggatagtagtggtgatcatccatacgtcttcggaactgggaccaaggtctccgtcctacgtcagcccaaggccaaactccactgtcactt

SEQ ID NO: 782466 - DNA, 527 bp, Homo sapiens
  misc_feature: HIJSMM301DK12B.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttacggtcggagggaccaggctgaccgtcctaggtcagcccaaggctcgccccctcggtcactctcgttcccgccctt

SEQ ID NO: 782467 - DNA, 510 bp, Homo sapiens
  misc_feature: HIJSMM301DM6XG.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgtcggtttattactgcctgcagagttattcactggccgtggacgttcggcgaaggaccgaaggtaggaaatacaaacgaaactcgtggcgtgcacgactcg

SEQ ID NO: 782468 - DNA, 502 bp, Homo sapiens
  misc_feature: HIJSMM301EE5NA.22.14.B03.1.454.light.4.raw
  modified_base (403)..(403): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagntgtggctagtttattattgtcaggcaatattatattccctccttcagacgttcggccaagggaccaaggtggaaatcaaacgaactgtggctgcaccta

SEQ ID NO: 782469 - DNA, 513 bp, Homo sapiens
  misc_feature: HIJSMM301AFPGW.48.36.D03.1.454.light.4.raw
agtatacatacacgaccggtgctcgatttagctgcgtcacgatctctcttggggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtcccccaaggtcattatttatgatgtcactaagcggccctcgggggtccctgatcgcttctctggctccagtctggcaacacggcctccctgaccatctctgggctccaggctgaagatcaggctgattattactgctgttctattttctaagtttccttttttgttctttcggaactgggaccgaggtcaccgtcctaggtcagcccaaggccaaccccactcgtcta

SEQ ID NO: 782470 - DNA, 510 bp, Homo sapiens
  misc_feature: HIJSMM301ARBU7.21.81.H04.1.454.light.4.raw
  modified_base (400)..(400): a, c, t, g, unknown or other
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtcttttatgactatgtctcctggtaccaacaatacccaggcaaagcccccaaactcatcatttatgatgtcagtaatcggccctcaggggtttctaatcgcttctctggctccaagtctggcaacacggcctccctgaccatctctcgggctccaggctgatgacgnggctgattattactgcaggtcatatacaatcagcaacacttatgtcgttcgggctgggaccaagatcaccgtcctaggtcagacccaaggcccaaccccactgtcctacc

SEQ ID NO: 782471 - DNA, 509 bp, Homo sapiens
  misc_feature: HIJSMM301DGPKX.41.26.C04.1.454.light.4.raw
tctatactatcacgaccggtgctcgatttagtctagcgactttgggtttggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctggggacagacttcacttctccaccgtcagccagactggaccctgaagattttgcagtgtattactgtcagcagtatggtagctcaccgatccaccttcggccaagggacacggactggagattaaccgaactgtcggctgcaccatctgtcttcta

SEQ ID NO: 782472 - DNA, 512 bp, Homo sapiens
  misc_feature: HIJSMM301ASCOF.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaactagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgagggacgaggctgattactactgctgctcatatgcaggtcgtatcttcttatgtcgttcggaactggaccgaaggtcaccgtcctaaggtcagcccaacggccaaccccactgtcta

SEQ ID NO: 782473 - DNA, 505 bp, Homo sapiens
  misc_feature: HIJSMM301A0DPC.19.85.H08.1.454.light.4.raw
  modified_base (481)..(481): a, c, t, g, unknown or other
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcngcccaaggctgccccctcggtcct

SEQ ID NO: 782474 - DNA, 509 bp, Homo sapiens
  misc_feature: HIJSMM301EIO4M.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttcgggtgttcggcggagggaccaaggctggaccgtcctaggtcagcccaaggctgccccctcggtcactcttcg

SEQ ID NO: 782475 - DNA, 519 bp, Homo sapiens
  misc_feature: HIJSMM301AHLOS.40.12.B01.1.454.light.4.raw
tctagcgactcacgaccggtgctcgatttagtagtgtagattccgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatggaggctgattattactgctactcgtatgcaggcggcaacaattgggtcttcggcggagggaccaagctgaccgtcctaggtcagcccaaggctcgccccctcggtcactctcgttcccta

SEQ ID NO: 782476 - DNA, 531 bp, Homo sapiens
  misc_feature: HIJSMM301C1YAL.27.23.C01.1.454.light.4.raw
agcgtcgtctcacgaccggtgctcgatttagtacacgtgattagggattggggggggtctcaggaggcagcgttctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtagacacttgggttgttcgggccggaggggaccagggctgacccgtctaggtcagcccaaggctcgccccctcgtcactctcgttcccgcccttcc

SEQ ID NO: 782477 - DNA, 506 bp, Homo sapiens
  misc_feature: HIJSMM301EBHZ3.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctcgaccgtcctgcgtcacgcccaaggctcgccccctcggtccactt

SEQ ID NO: 782478 - DNA, 486 bp, Homo sapiens
  misc_feature: HIJSMM301EBW6I.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggaccagcagaagccaggccaggcccctctcttgattatatataaggacactgagaggccctcagggatccctgagcgattctctggctccagctcaggacaacactcaccttgaccatcagtgcagtccaggcagaagacgaggctgactattattgtcaatcagcagtcagcactaattcttatcgggtgttcggcggagggaccaagctgaccgtcctacggtcacgcccaaggctcgccccctcggtct

SEQ ID NO: 782479 - DNA, 482 bp, Homo sapiens
  misc_feature: HIJSMM301D4C7H.53.29.C07.1.454.light.4.raw
cgcgtatacacacgaccggtgctcgatttagagtgctacgaagggaaagggggggcctcaggaagcagcatcggaggtgcctcagccatggcatggatccctctcttcctcggcgtccttgcttactgcacaggatgcgtggcctcctatgagctgactcagccaccctcagtgtccgtgtccccaggacagacagccagcatcacctgctctggagacaagttgggggataaatatgctggctggtatcagcagaagccaggccagtcccctgtgttagtcatctatcaagatacaaagcggccctcagggatccctgagcgattctctggctccaactctgggaacacagccactctgaccatcagcgggactcaggctatcgatgaggctgactattactgtcaggcgtgggacagccgcactgggggtgttcgggcggagggaccaagctgaccgtcctgagtcagcccaaggctccg

SEQ ID NO: 782480 - DNA, 521 bp, Homo sapiens
  misc_feature: HIJSMM301EV52J.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcacgcccaaggcctacgccccctcggtccactctcgttccctaccccc

SEQ ID NO: 782481 - DNA, 504 bp, Homo sapiens
  misc_feature: HIJSMM301BS5TK.21.38.D05.1.454.light.4.raw
tcgtcgctcgcacgaccggtgctcgatttagtatctgatagttgggtttgggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagttgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagtattttgcagtgtattactgtcagatgtatggtaggtcaccgtacacctttggccaggggaccaagggtggagatcagacgaactgtggctgcaccatctgtcttcatt

SEQ ID NO: 782482 - DNA, 495 bp, Homo sapiens
  misc_feature: HIJSMM301AT5BX.40.8.A08.1.454.light.4.raw
tctagcgactcacgaccggtgctcgatttagcatactctacagggggctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgtttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagttacttactgtcaccaatatttagacattcctccgacgttcgccaaggaccaaggtggagatcaaacgaaacgtcgtggctgcaccata

SEQ ID NO: 782483 - DNA, 511 bp, Homo sapiens
  misc_feature: HIJSMM301A4927.16.46.E02.1.454.light.4.raw
  modified_base (372)..(372): a, c, t, g, unknown or other
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctnaccatctctgggctccaggctgaggacgaggctgattatactgcagcttatatacaggcaacaataatttgttcttcggaactaggaccgaacggtacaacgtccgtacgttacgacgccaacgacgaacccacctacc

SEQ ID NO: 782484 - DNA, 498 bp, Homo sapiens; identical to SEQ ID NO: 544885
  misc_feature: HIJSMM301CKUT5.3.71.G05.1.454.light.4.raw

SEQ ID NO: 782485 - DNA, 525 bp, Homo sapiens
  misc_feature: HIJSMM301AQK03.27.23.C01.1.454.light.4.raw
  modified_base (519)..(519): a, c, t, g, unknown or other
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacgttggtgttcggcggagggaccaggctcgaccgtcctaggtcacgccaaggctcgcccctcggtcactctcgtcccnccctcc

SEQ ID NO: 782486 - DNA, 498 bp, Homo sapiens
  misc_feature: HIJSMM301DPEBS.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaagagccaccctctcctgcagggccagtcagagtgttaactactacttagcctggtaccaacagaaacctggccaggctcccaggctcctcatctatgatgcatcttacagggccactggcatcccagccaggttcagtggcaggtgggtctgggacagacttcactctcaccatcagcagcctagagcctgaagattttgctagtttattactgtcagcagcgtagcaactccctcacgttcggcggaggaccgaaggtggagatcaaacgaactgtggctgcaccatctgtcttcatcttcccgcc

SEQ ID NO: 782487 - DNA, 506 bp, Homo sapiens; identical to SEQ ID NO: 570478
  misc_feature: HIJSMM301ARLMZ.22.21.B10.1.454.light.4.raw

SEQ ID NO: 782488 - DNA, 492 bp, Homo sapiens
  misc_feature: HIJSMM301DFHKT.51.28.C06.1.454.light.4.raw
  modified_base (458)..(458): a, c, t, g, unknown or other
  modified_base (479)..(479): a, c, t, g, unknown or other
cgatcgtatacacgaccggtgctcgatttagagctcacgtattggggtttgggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgtacttttactgtcaggcgtgggacagcgacactgccggtggttcgggcgggggacaagcngaccgtctcggcacgccagcncgcccctcggtct

SEQ ID NO: 782489 - DNA, 493 bp, Homo sapiens
  misc_feature: HIJSMM301ADYHT.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccgccagggccactggtttcccagccaggttcagtggcagtgcgtctgcgacagagttcactctcaccatcaacagcctgcagtctgaagtattttgctagtttattactgttcagcagtatcatgactgaccgcctccaccttcggccaaagggacacgacgtggagaattaaacgaacgtgtggctgcaccat

SEQ ID NO: 782490 - DNA, 518 bp, Homo sapiens
  misc_feature: HIJSMM301DLXCI.5.27.C05.1.454.light.4.raw
atcagacacgcacgaccggtgctcgatttagacgcgatcgaaaggggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactgggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagccaaggccaaccccactgtcactctgttcccgccctcct

SEQ ID NO: 782491 - DNA, 511 bp, Homo sapiens
  misc_feature: HIJSMM301EVFUK.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactccatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtctaggtcagccaaggctcgccccctcggtccactctcgtt

SEQ ID NO: 782492 - DNA, 488 bp, Homo sapiens
  misc_feature: HIJSMM301BI6KK.52.35.D02.1.454.light.4.raw
cgcagtacgacacgaccggtgctcgatttagcacacgatagttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcgaggggggacgtatccctgatcgcttctcaggctccggctcgtgggactgagcgctacctcaccatctccagcctccagtctgaggacgagggtgactattactgtcagacgtgggacactggctagtttgggtggttcgggcggacgggaccaaggttggaccgttaccgtaggtcgacgg

SEQ ID NO: 782493 - DNA, 493 bp, Homo sapiens
  misc_feature: HIJSMM301ECXRH.49.17.B06.1.454.light.4.raw
  modified_base (439)..(439): a, c, t, g, unknown or other
agtcgagagacacgaccggtgctcgatttagtcgatagtgaagggggtggggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctcctggctccagctcagggacaacagtcacttgaccatcagtggagtccgggccagaggacgaggctgactattactgtcagtccgcagacagcagtggcagttatgtcgtatcggnggagggactacgctgaccgtctaggtcagccaaggctcgcccctcggtcactcc

SEQ ID NO: 782494 - DNA, 493 bp, Homo sapiens
  misc_feature: HIJSMM301CBXNS.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagttttgcacagtggggtcccgtcaaggttcagtggcagtggatctgggacagatttcactctcaccgtcagcagtctgcaacctgaagattttgcaacttactactgtcaacagagttacacgtacccccctcactttcggcggacgggaccaaggcggagatcagacgaactgtaggctgcaccatctgtcttcta

SEQ ID NO: 782495 - DNA, 506 bp, Homo sapiens
  misc_feature: HIJSMM301B56QI.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccggggccactttcggccctggaccaggtggagatcaaacgaactgtggctgcaccatctgtcttcta

SEQ ID NO: 782496 - DNA, 507 bp, Homo sapiens
  misc_feature: HIJSMM301EQ6PV.21.22.B11.1.454.light.4.raw
  modified_base (433)..(433): a, c, t, g, unknown or other
  modified_base (472)..(472): a, c, t, g, unknown or other
tcgtcgctcgcacgaccggtgctcgatttagacgacagctcagggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggccccccaaactcctcatccagaggaataatcagcggccctcaggggtccctgaccgattctctggctccaagtctggcacctcagcctccctgaccatcagtgggctccggtccgaggatgaggctgacttattactgtgcatcacggggacncaacatgggatgacaattctgagcgggttggtgttcggnggagggacccaaagtgaaccgtcctaggtcagccc

SEQ ID NO: 782497 - DNA, 496 bp, Homo sapiens
  misc_feature: HIJSMM301EIFJ6.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcaagaaaccagggaaagcccctaagctcttgatctatggtgcatccagtttaaaagtggggtcccatcaaggttcagcggcagtggatctggcacagacttcattctcaccatcagcagcctgcagcctgaagtattttgactaacttattactgtactacaagatcacaattatcctgggacgttcggccgaacgggaacgaacggtaggaaatcgaaacgtaactcgtaggctcg

SEQ ID NO: 782498 - DNA, 489 bp, Homo sapiens
  misc_feature: HIJSMM301EIR3O.47.70.G04.1.454.light.4.raw
  modified_base (480)..(480): a, c, t, g, unknown or other
  modified_base (486)..(486): a, c, t, g, unknown or other
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggcctaggggaccaaactggacatcaaacgaactagtgctgcnccatcngtt

SEQ ID NO: 782499 - DNA, 513 bp, Homo sapiens
  misc_feature: HIJSMM301EUYY5.3.79.H02.1.454.light.4.raw
agacgcactccacgaccggtgctcgatttagtgtcacacgaagggaaagggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctccggccctcaggggtttctcatcgcttttctggctccaagtctggcaccacggcctccctgaccatcgtcggggctccaggctgaggacgaggctgcttattactgcagctcatataacaaggagcaccactctcgtggttatttggtggagggaccaagctgaccgtcctaggtcacgcccaaggctcgccccctcggt

SEQ ID NO: 782500 - DNA, 504 bp, Homo sapiens
  misc_feature: HIJSMM301B4XUE.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtccaccgtcctaggtcagcccaacggccaacccc

SEQ ID NO: 782501 - DNA, 512 bp, Homo sapiens
  misc_feature: HIJSMM301EHHSQ.40.16.B05.1.454.light.4.raw
tctagcgactcacgaccggtgctcgatttagagctcacgtaaggggggggtctcaggaggcagcactctcgggacgtctccaccatggcctgggctctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctccaggctgaggatgaggctgattattactgctgctcatttgctaggttagtttttgggtgtttcggcggagggaccaagctgaccgtcctaggtcagcccaaggcctgccccctcggtcactctcgttcccg

SEQ ID NO: 782502 - DNA, 494 bp, Homo sapiens
  misc_feature: HIJSMM301BQAUH.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctggccatctctgggctccagactgaggatgaggctacttattttgctgctcttatgcaggcagtttcgctctcgagtgttcggcggaggacgagctgaccgtcctacgtcagccaaggctccg

SEQ ID NO: 782503 - DNA, 496 bp, Homo sapiens
  misc_feature: HIJSMM301BDP22.43.34.D01.1.454.light.4.raw
tgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttatgagggcactaagcggccctcaggggtttctgatcgcttctctggctccaagtctggcaacacggcctcctgacaatctctgggctccaggctgaggacgaggctgatttattattgctgcctcatatgcaggtagttacactttattgtcttcgggaattgggacgacggtccaccgtcctaggtcagcccaa

SEQ ID NO: 782504 - DNA, 509 bp, Homo sapiens; identical to SEQ ID NO: 767153
  misc_feature: HIJSMM301AVG5X.3.79.H02.1.454.light.4.raw

SEQ ID NO: 782505 - DNA, 494 bp, Homo sapiens
  misc_feature: HIJSMM301AHOE4.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccacggctacggatgaggctgactattactgtcaggcgtgggacagcagcacctattgtgggttttcggcggagggaaccgaagctgaccgtccttggtcagcccaaggctgtccccccg

SEQ ID NO: 782506 - DNA, 508 bp, Homo sapiens
  misc_feature: HIJSMM301EQPDO.5.60.F05.1.454.light.4.raw
  modified_base (478)..(478): a, c, t, g, unknown or other
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaaacatcggaagtaatattgtaaactggtaccagcagctcccaggaacggcccccaaactcctcatctataggaataaatcaacggccctcaggggtccctgaccgattctctggctccaagtctggcacctcagcctccctggccatccgtgggctccagtctgaggatgagtctgattattactgttgcaacatgggatgacagcctgaatggtccggtaattcggcggagggaccaancctgaccgtcctcggtcagcccaaggctcg

SEQ ID NO: 782507 - DNA, 484 bp, Homo sapiens
  misc_feature: HIJSMM301DC0LJ.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccagaccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggcatcgctgggctccaggctgacgatgaggctgattattattgtccagtcctatgacaacaccctgcgttggttttggtctggttcggcggcgggacc

SEQ ID NO: 782508 - DNA, 464 bp, Homo sapiens
  misc_feature: HIJSMM301E2E33.41.14.B03.1.454.light.4.raw
tctatactatcacgaccggtgctcgatttagtgtgagtagttccgcgggcacgaccggtgctcgatttagtgtgagtagttccgcgggcacgaccggtgctcgatttagtctagcgactttgggtttggggggaaagagccaccctctcctgcagggccagtgagacagttactgtcaattacttagcctggtaccagcagaagcctggccaggctcccaggctcctcatctctgctgcctcctacagggccactggacatcccagacaggttcagtggcagtgggtctgggacagacttcactctctccatcagcagactggagcctgaagattttgcaatttattactgtcaccagtatggtagttcacctctaactttcggcggagggaccaaggtggagatacaaacgaactgtggctgcaccatctgtcttcatcttcccgccatctgaatagtataga

SEQ ID NO: 782509 - DNA, 505 bp, Homo sapiens
  misc_feature: HIJSMM301BCFHQ.19.67.G01.1.454.light.4.raw
tactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaagctgacccgtcctaggtcagccaaggctcgcccccttcc

SEQ ID NO: 782510 - DNA, 513 bp, Homo sapiens
  misc_feature: HIJSMM301B9NIN.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggtttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccct

SEQ ID NO: 782511 - DNA, 483 bp, Homo sapiens; identical to SEQ ID NO: 549135
  misc_feature: HIJSMM301EEQ7B.21.25.C03.1.454.light.4.raw

SEQ ID NO: 782512 - DNA, 528 bp, Homo sapiens
  misc_feature: HIJSMM301ETGXE.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatcctccgggctccagcctgaggacgaggctgattattattgtagttcatatacaaccagtgacacgtttgggtagttcggcgggagggaccaggctgaccgtcctaggtcagacccaaggctcgccccctcgtcactctcgttcccaccct

SEQ ID NO: 782513 - DNA, 518 bp, Homo sapiens
  misc_feature: HIJSMM301AP0G7.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatggaggctgagtatcactgtggagagagccacacaattgatggccaagacggttgggtgttcgggcggagggaccaagctgaccgtcctaggtcagcccaaggctcgccccctcggtccactctcgttccccaccctccctcgctacgt

SEQ ID NO: 782514 - DNA, 517 bp, Homo sapiens
  misc_feature: HIJSMM301AVM5L.43.38.D05.1.454.light.4.raw
tgtgagtagtcacgaccggtgctcgatttagtatctgatagttgggtttgggggtgctcgatttagtatctgatagttgggtttggggggagtcagacccagtcaggacacagcctggacatgagggtcccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtccctcaaggttcagcggcagtgcatctgggacagatttcactctcaccatcagcagcctgcagcctgatgattttgctaactttattactgtcaacagtataatacgttacccctggacgttcggaccgaacgggaccgagggtaggaaagtacgaaacgaac

SEQ ID NO: 782515 - DNA, 499 bp, Homo sapiens
  misc_feature: HIJSMM301AOQSO.9.50.E06.1.454.light.4.raw
tgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgctagtttattactgtcagcagcgtagcaactggcctcggacgttcggccgaacggaccgaagtaggacatacagacgaactgcggtctgcaccactcttacg

SEQ ID NO: 782516 - DNA, 492 bp, Homo sapiens
  misc_feature: HIJSMM301AMP9N.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgctagtttattactgtcagcagtataataactggcctccggtcactttcggcggagggaccaaggtggagatacaaacgaactagtggctgcaccat

SEQ ID NO: 782517 - DNA, 516 bp, Homo sapiens
  misc_feature: HIJSMM301CAUAJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggactagatttcactctcaccatcagcagcctgcaggctgaagatgtggctagtttattactgtcaactagtttctcgggcgttcggccgaaggaccgaaggtagaagtacaaacgaactagtaggtcgtgcaccactctgttcttctacttccttccccg

SEQ ID NO: 782518 - DNA, 529 bp, Homo sapiens
  misc_feature: HIJSMM301EX94F.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactcttactttggtggtgctgtgctattcggcggagggaccaagctgaccgtcttaaagtcaagccccaagggcctcgcccccctcggtccactctcgttccccacccttccctccc

SEQ ID NO: 782519 - DNA, 512 bp, Homo sapiens
  misc_feature: HIJSMM301AW63K.18.78.H01.1.454.light.4.raw
tacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaaagcagcagcactcaagtcttcggaactgggaccaaggtcaccgtcctaggtcagcccaacggcccaaccccacctgtcta

SEQ ID NO: 782520 - DNA, 516 bp, Homo sapiens
  misc_feature: HIJSMM301DMXIZ.16.46.E02.1.454.light.4.raw
tgtactactccacgaccggtgctcgatttagactcatctacagggaaaggggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagctttatatacaggtcaacaattacttttgtcttcggaactgggaccaaggtcaccgtctaggtcagcccaaggcccaaccccactgtcactcttcg

SEQ ID NO: 782521 - DNA, 517 bp, Homo sapiens
  misc_feature: HIJSMM301ED2PD.7.34.D01.1.454.light.4.raw
cgtgtctctacacgaccggtgctcgatttagatcgtctgtggttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttgggtggttataactatgtctctggtaccaacaataccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacgaggggacagctatttatttggggttcgttcgggcgggtagggaccaaggctgaccgtcctgccgtcagacccgaaggctcgccccc

SEQ ID NO: 782522 - DNA, 501 bp, Homo sapiens
  misc_feature: HIJSMM301AH7TQ.48.59.F04.1.454.light.4.raw
  modified_base (238)..(238): a, c, t, g, unknown or other
agtatacatacacgaccggtgctcgatttagtacacacacttagggattgggggtgggctcaggaggcagagctctgggaatctcaccatggcctggacccctctcctgctcccccctcctcactttctgcacagtctctgaggcctcctatgagctgacacagccaccctcggtgtcagtgtccccagaacaaacggccaggatcacctgctctggagatgcattgccaaaaaaatntgcttattggtaccagcagaagtcaggccaggcccctgtgctggtcatctttgaggacaacaaacgaccctccgggatccctgagagattctctggctccagctcagggacaatggccaccttgactatcaatgggccaggtgacgatgaggctgactactactgttcctcaacagacagtagtggtgatcgagggctgttcggcggagggaccaagctgaccgtcctagtcagccaaggctgccccctcggtccactcttcg

SEQ ID NO: 782523 - DNA, 506 bp, Homo sapiens
  misc_feature: HIJSMM301CBNOK.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcactcccagccaggttcagtggcagtgggtctgggacagacttcactctcaccatcagcagcctagagcctgaagtattttgctagtttattactgtcagcagcgtagcaactcggcctctcacgtttcggccgggagggaccgaaggtggagatacaaacgaactgtggtctgcaccatctgttctt

SEQ ID NO: 782524 - DNA, 517 bp, Homo sapiens
  misc_feature: HIJSMM301DOPZP.2.35.D02.1.454.light.4.raw
  modified_base (376)..(376): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctcctgaccgtcnctgggctccaagctgaggatgaggctgattattactgcagctcatatgcaggcagcagcaatgtactttggcgggtaggaccaagctacgaccgttccgtgggtccacgacccgaaggtcctccggcccccgtcggtacct

SEQ ID NO: 782525 - DNA, 488 bp, Homo sapiens
  misc_feature: HIJSMM301EXBPM.10.2.A02.1.454.light.4.raw
catagtagtgcacgaccggtgctcgatttagactcatctacgagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacaggccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggcccgcgacgttcggccaagggaccgaggtggaattcaaacgaacagtggctgcaccatctgtctt

SEQ ID NO: 782526 - DNA, 498 bp, Homo sapiens
  misc_feature: HIJSMM301BRSQT.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccgaagggaccgaaggtggaaatacaaacgaacgtggtggct

SEQ ID NO: 782527 - DNA, 502 bp, Homo sapiens
  misc_feature: HIJSMM301BCGPJ.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctactcgacttttcggacggtaggggacccgaagggtggtacgatacaaaccgaactacgt

SEQ ID NO: 782528 - DNA, 497 bp, Homo sapiens
  misc_feature: HIJSMM301DOZ8F.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatccagcagactggagcctgaggtattttgcagttgtattactgtcagcagtatcataggtacaaacaccttcggccaagggacacgactggagattaaaggaactgtggctgcacatctgtcttcatcttccccg

SEQ ID NO: 782529 - DNA, 509 bp, Homo sapiens; identical to SEQ ID NO: 754209
  misc_feature: HIJSMM301BP57B.18.78.H01.1.454.light.4.raw

SEQ ID NO: 782530 - DNA, 509 bp, Homo sapiens
  misc_feature: HIJSMM301BH8SD.19.78.H01.1.454.light.4.raw
  modified_base (502)..(502): a, c, t, g, unknown or other
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtccaccgtcctaggtcagcccaaggcccaaccccacngtctacc

SEQ ID NO: 782531 - DNA, 511 bp, Homo sapiens
  misc_feature: HIJSMM301BAH03.21.87.H10.1.454.light.4.raw
  modified_base (486)..(486): a, c, t, g, unknown or other
tcgtcgctcgcacgaccggtgctcgatttagcagtactgcgttgggtttgggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaacgacgaggctatttattactgctcctcatacgcaggtggcactatttttctttggtttttggcggcgggacccagatgactgtcctcngtcagccaaggctcgccccctcggt

SEQ ID NO: 782532 - DNA, 510 bp, Homo sapiens
  misc_feature: HIJSMM301B7IL0.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcgggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttcgtggcctccgctctactttcgggccggagggaccgagggtggagatacaaacgaactggtggctgcaccatcgtgtcttcatccttccccg

SEQ ID NO: 782533 - DNA, 488 bp, Homo sapiens
  misc_feature: HIJSMM301C4HTN.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtgcagtggatctgggacagatttcactctcaccgtcagcagtctgcaactgaagattttgcaacttactactgtcaacagagttacagtacccccctcactttcggcggtagggaccaaggcggagatcagacgaactgtggctgcaccatctgtcttcta

SEQ ID NO: 782534 - DNA, 492 bp, Homo sapiens
  misc_feature: HIJSMM301ASJK2.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctacggtcagcccaa

SEQ ID NO: 782535 - DNA, 481 bp, Homo sapiens
  misc_feature: HIJSMM301BRE3Q.41.8.A08.1.454.light.4.raw
tctatactatcacgaccggtgctcgatttagcatactctacagggcacgaccggtgctcgatttagcatactctacaggggggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtgggtcccatcaaggttcagcggcagtggatctgggacagatttcactctcaccatcagcagcctgcagcctgacgattttgcaacttactattgtcaacaggctaacagtttcccgatcgaccgtcggccaagggacacg

SEQ ID NO: 782536 - DNA, 359 bp, Homo sapiens
  misc_feature: HIJSMM301DQW1E.40.9.A09.1.454.light.4.raw
tctagcgactcacgaccggtgctcgatttagcgagacgcgcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccggggagtccggggtccctgaccgattcagtgccagcgggtctgggacagacttcactctcacca

SEQ ID NO: 782537 - DNA, 466 bp, Homo sapiens
  misc_feature: HIJSMM301E2E2D.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtggttcgggcgggagggaccaggctgaccgtcctaggtcagcccaaggctcgccccctcggtcactctcgttccccaccctcctcacgcgtatgt

SEQ ID NO: 782538 - DNA, 485 bp, Homo sapiens
  misc_feature: HIJSMM301D4ES3.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctcaagtctggcaacacggcctccctgacaatctctgggctccaggctgacgacgaggctaattattactgctgctcatatgaaggttataacactatactattcggcggagggaccaagactgaccgtcctgcgtcagcccaaggctgccccctcggtcactctcgttcccaccctcctcgctacgtga

SEQ ID NO: 782539 - DNA, 447 bp, Homo sapiens
  misc_feature: HIJSMM301A5GKJ.5.9.A09.1.454.light.4.raw
atcagacacgcacgaccggtgctcgatttagcgagacgcgcaggggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaactgtttgggtgtttgggtgttcggcggagggaccaagctgaccgtcctaagtcagcccaaggctcgccccctcggtcactctcgttcccaccctcctccgtgtctgat

SEQ ID NO: 782540 - DNA, 505 bp, Homo sapiens
  misc_feature: HIJSMM301BN3LW.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcaccaggcaaagcccccaaactcatgatttatgatgtcagtaatcggcctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaacccactgtcta

SEQ ID NO: 782541 - DNA, 507 bp, Homo sapiens
  misc_feature: HIJSMM301EHNAQ.22.5.A05.1.454.light.4.raw
  modified_base (352)..(352): a, c, t, g, unknown or other
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttnactctcaccatcagcagcctagagcctgaagattttgctagtttattactgtcagcagcgtagcaactccctcacgttcggcggagggaccaagggtggagatacaaacgaactagtggctgcaccatctcgtcttcatcctttcccgccatccg

SEQ ID NO: 782542 - DNA, 461 bp, Homo sapiens
  misc_feature: HIJSMM301EHY5T.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtccactctgttcccgccctcctcgtatctctcg

SEQ ID NO: 782543 - DNA, 505 bp, Homo sapiens
  misc_feature: HIJSMM301EM5S2.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaacccactgtcactcctgttcccgccct

SEQ ID NO: 782544 - DNA, 517 bp, Homo sapiens
  misc_feature: HIJSMM301C3BT4.43.57.F02.1.454.light.4.raw
tgtgagtagtcacgaccggtgctcgatttagctcgatatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccacctgaccgtctctgggctccagggctgaggatgagactcattattactgcagtctcatatacagggacaaacaagtaaagtttggtagttcgggcgggaggggaccgagctgaccgtcctaggtcagcccaaggctcgtccccccg

SEQ ID NO: 782545 - DNA, 498 bp, Homo sapiens
  misc_feature: HIJSMM301ENI1H.15.81.H04.1.454.light.4.raw
tctacgtagccacgaccggtgctcgatttagtagtgtagattcgcggggggggtctcaggaggcagcgctctcaggacatctccacaatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaaagtggcagcactctcgtatcggcggtggaccaagcctgaccgtccttaggcagcccaaggcctgccccctc

SEQ ID NO: 782546 - DNA, 492 bp, Homo sapiens
  misc_feature: HIJSMM301AYHQ9.48.57.F02.1.454.light.4.raw
agtatacatacacgaccggtgctcgatttagctcgatatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggtttttggtatcagcagaagtcaggccaggccccaagactgctcatgtatagagacagtgagaggtcctcagggatccctgagcgattctctggctccagctcgtgggacgacactcactctgactatcagtgaagtccgggcagaagacgaggctgactactattgtcagtcaggagacaatactcgcacgcaagttacgtgttcggcggagggaccaaaggctgacagtcctaggtcagcccaaggt

SEQ ID NO: 782547 - DNA, 515 bp, Homo sapiens
  misc_feature: HIJSMM301BTQIM.49.27.C05.1.454.light.4.raw
  modified_base (467)..(467): a, c, t, g, unknown or other
  modified_base (501)..(501): a, c, t, g, unknown or other
agtcgagagacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacgttggtacttataattctgtctcctggtaccaacaatacccggcaaagtccccaaactcatgatctttgaggtcagtgatcggcccgcaggggtttctcatcgcttctccggctccaagtctggcagcacggcctccctgaccatctctgggctccaggctgaggacgagggctgattattactgcagctcatatacaaacataacacttgggtgttcggcggcggaccaaacgtnaccgtctacgtcagccaggctgccccctggtacnctctgtcccaccct

SEQ ID NO: 782548 - DNA, 516 bp, Homo sapiens
  misc_feature: HIJSMM301BVKKX.9.53.E09.1.454.light.4.raw
  modified_base (441)..(441): a, c, t, g, unknown or other
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagcacccaggcaaacgcccccaaactcatcatttatgaggtcactaagcggccctcaggggtttctattcgcttctctggctccaagtctgacaacacggcctccctgacaatctctgggctccaggctgaggacgaggctgatttattactgctgctcatatgcagatgggtnaccactcccgtggtagttcggcgggagggaccaaggtcgaccgtcctaggtcacggcccaaggctcgtccccccg

SEQ ID NO: 782549 - DNA, 505 bp, Homo sapiens
  misc_feature: HIJSMM301D2IRL.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagattttgtagttttattactgtcagcagtatagcagctggcctccactttcggcggagggaccaagggtggagatccaacgaactgtggctgcaccatctgtcttcatccttcccg

SEQ ID NO: 782550 - DNA, 509 bp, Homo sapiens
  misc_feature: HIJSMM301EH5NV.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaaacacggcctccctgaccatctctgggctcgagtctgaggacgaggctgattacttctgttgctcttgggcaactactgttcgttgggtgttcggcggagggaccaagttgaccgtcctaggtcagccaaggctgccccctcggtcacttc

SEQ ID NO: 782551 - DNA, 507 bp, Homo sapiens
  misc_feature: HIJSMM301B6SDQ.18.11.A11.1.454.light.4.raw
  modified_base (400)..(400): a, c, t, g, unknown or other
  modified_base (488)..(488): a, c, t, g, unknown or other
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggacgtccggggtccctgaccgattcagaggcagcgggtctgggacagatttcactctcaccatcaccaacctgcaggctgaagntgtggactagtttattactgtcagcaatactatacgtcctcctctcacgttcggcggagggaccaaggtcggagatacaaacgactgnggctagcaccatctgtctt

SEQ ID NO: 782552 - DNA, 498 bp, Homo sapiens
  misc_feature: HIJSMM301CU3XZ.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcacgcccaacggccaaccccactgta

SEQ ID NO: 782553 - DNA, 493 bp, Homo sapiens
  misc_feature: HIJSMM301A1D8A.41.82.H05.1.454.light.4.raw
  modified_base (448)..(448): a, c, t, g, unknown or other
tctatactatcacgaccggtgctcgatttagtcgagctctctcgcgggagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaggaccaagtagaatnaaacgaactagtggctgcaccatctgtcttcatcttcccgcctac

SEQ ID NO: 782554 - DNA, 488 bp, Homo sapiens
  misc_feature: HIJSMM301CKKBB.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtccatcaaggttcagtggcgccggatctgggacagaattcactctcaccatcagcgggctccagtctgaggactctgcaacttattactgccaacaatatgattatttattctccagcgttcggcaggggaccaaggtggaagtcaagcgaactgtggctgcaccatctgtt

SEQ ID NO: 782555 - DNA, 460 bp, Homo sapiens; identical to SEQ ID NO: 536053
  misc_feature: HIJSMM301AN74B.22.28.C06.1.454.light.4.raw

SEQ ID NO: 782556 - DNA, 518 bp, Homo sapiens
  misc_feature: HIJSMM301ASPCQ.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtcccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcggggcccaggcagatgatgagtgtgtattattactgtgtgctctatatgggcagtggcggtttgggttggttcgggtcgggacgggaccgaagctggtaccgttcg

SEQ ID NO: 782557 - DNA, 510 bp, Homo sapiens
  misc_feature: HIJSMM301CH6YG.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttcacgtttcggcggtagggaccaaggttggacctcaaacgaactgtggctgcaccatctgtcttcatccttcccgcc

SEQ ID NO: 782558 - DNA, 492 bp, Homo sapiens
  misc_feature: HIJSMM301A80C7.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaacccagggaaagcccctaagctcctgatctacgatgcatcccaatttggaaacaggggtcccatcaaggttcagtggaagtggatcgtgggacagtattttactttcaccatcagcagccctgcagcctagaagatattgcaacattattactgtcaacagtatcatatactcccctactttcggccctggaccaagtgatatacaaacgaactgtggctgcaccatctgtt

SEQ ID NO: 782559 - DNA, 518 bp, Homo sapiens
  misc_feature: HIJSMM301B0U9O.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatataacaaccagtgacacgttgggtggtttcggcggagggaccgaggcgtgaccgtcctggtcagccaaggctgcccctccgtcactctgttccc

SEQ ID NO: 782560 - DNA, 504 bp, Homo sapiens
  misc_feature: HIJSMM301DLBKX.13.10.A10.1.454.light.4.raw
tcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttggaacaaagctgcccttatcatcacgggggcccaggcagaagatgaatctgattattactgtgttctttatatgggtagtgccatttctgctgttgttcggaggaggcaccggctgaccgttcctcggtccacgccaaggctcgcccctcggt

SEQ ID NO: 782561 - DNA, 522 bp, Homo sapiens; identical to SEQ ID NO: 543352
  misc_feature: HIJSMM301DD9FA.27.23.C01.1.454.light.4.raw

SEQ ID NO: 782562 - DNA, 500 bp, Homo sapiens
  misc_feature: HIJSMM301AUOLQ.49.60.F05.1.454.light.4.raw
agtcgagagacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggaccaacccactgtcactcttccg

SEQ ID NO: 782563 - DNA, 486 bp, Homo sapiens
  misc_feature: HIJSMM301EBBHQ.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccaggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggtagggaccaaggtggaggatcaaacgaact

SEQ ID NO: 782564 - DNA, 497 bp, Homo sapiens
  misc_feature: HIJSMM301AK03Q.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactagaaaatcagcagagtggaggctgaggatggtttggggtttattactgcatgcaagctctacaaactccttactacttttggtccgaggggaccaagctggagatacaaacgaacta

SEQ ID NO: 782565 - DNA, 495 bp, Homo sapiens
  misc_feature: HIJSMM301BTND4.53.32.C10.1.454.light.4.raw
cgcgtatacacacgaccggtgctcgatttagtatagacatcaacacacaaaggggctgggcctcaggaagcagcatcggaggtgcctcagccatggcatggatccctctcttcctcggcgtccttgcttactgcacaggatcggtggcctcctatgagctgagtcagccaccctcagtgtccgtgtccccaggacagacagtccgcatcacctgctctggagataaattgggggataaatttgcttgctggtatcaacagaagacagggccagtcccctgtgttggtcatttatcaagatgacaagcggccctcagggatccctgagcggttctctggctccaactctgggaacacagccactctgaccatcagcggacccaggctatggatgaggctgactattactgtcaggcgtgggacagcagcactatggtgttcgggtcggagggaccaaggctggacccgtaccgtaggtcacgcccaagggctcccc

SEQ ID NO: 782566 - DNA, 500 bp, Homo sapiens
  misc_feature: HIJSMM301DVCB6.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtaggaaatcaaacgaactgtaggctgcaccta

SEQ ID NO: 782567 - DNA, 508 bp, Homo sapiens
  misc_feature: HIJSMM301AJYVH.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggaggaccaagctgaccgtccgtgggtcagcccaaggcctcgccccctcggtctacc

SEQ ID NO: 782568 - DNA, 479 bp, Homo sapiens
  misc_feature: HIJSMM301EII97.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcacgcctccctggtcatcgctgggctccaggctgacgatgaggctgattattattgccagtcctatgacaacaccctgcgtggttttggctgttcggcggcggg

SEQ ID NO: 782569 - DNA, 522 bp, Homo sapiens
  misc_feature: HIJSMM301EHBBU.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggcccaaccccactgtcactctgttcccaccctccta

SEQ ID NO: 782570 - DNA, 490 bp, Homo sapiens
  misc_feature: HIJSMM301AWK3V.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgctagtttattactgtcagcagtatgatacctggcctccgtacacttttggccgggggaccagctggaaatcaagcgaactgtggctgcaccatctgtcttc

SEQ ID NO: 782571 - DNA, 473 bp, Homo sapiens
  misc_feature: HIJSMM301C9558.53.83.H06.1.454.light.4.raw
cgcgtatacacacgaccggtgctcgatttagatcacgtgcgtcgcgggctgggcctcaggaagcagcatcggaggtgcctcagccatggcatggatcccctctcttcctcggcgtccttgcttactgcacaggatccgtggcctcctatgagctgactcagccaccctcagtgtccgtgtccccaggacagacagcgaccatcacctgttctggagacaaattgactgataaatatgctggctggtatcggcagaagccaggccagtcgcctgtgttggtcatctatcaggatagcaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagaccccg

SEQ ID NO: 782572 - DNA, 507 bp, Homo sapiens
  misc_feature: HIJSMM301BULBU.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccgactgtcta

SEQ ID NO: 782573 - DNA, 525 bp, Homo sapiens
  misc_feature: HIJSMM301BCTCL.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcataatacaaccagtgacacttgggtgttcggcggagggaccaggctgaccgtcctaggtcaggcccaaggctggccccctcggtcactctgttcccgccctt

SEQ ID NO: 782574 - DNA, 499 bp, Homo sapiens
  misc_feature: HIJSMM301B9PMV.18.26.C04.1.454.light.4.raw
  modified_base (485)..(485): a, c, t, g, unknown or other
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaactagtggctgcaccatctntcttcatccttccc

SEQ ID NO: 782575 - DNA, 508 bp, Homo sapiens
  misc_feature: HIJSMM301D9EOZ.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgagtcactacgcgaccctcaggggtccctgatcgcttctctggctccaagtctggcaacacggcctccctgaccgtctctggctccaggctgaggatgaggctgattattactgcagctcatatgcaggcagcaagcagtccccatgttgacttcttcgggcggggggaccaagctcgaccgtcctaggtcacgcccaaggccg

SEQ ID NO: 782576 - DNA, 507 bp, Homo sapiens
  misc_feature: HIJSMM301C5J21.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggacaagctgaccgtcctaggtcagcccaaggctcgccccctcggt

SEQ ID NO: 782577 - DNA, 487 bp, Homo sapiens
  misc_feature: HIJSMM301DZYKV.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttttatacagctccaacaataagaacttcttagcttgtaccagcagaaaccaggacagcctcctaagctgctcatttactgggcatctatccgggaatccggggtcctgaccgattcagtggcagcgggtctgggacagatttcactctcaccatcagcagcctgcaggctgaagatcgtggcagtttattactgtcagcaatatatagtctacctcgaggctcacttcggcggaggccgaaggtggagatcaaacgaa

SEQ ID NO: 782578 - DNA, 497 bp, Homo sapiens
  misc_feature: HIJSMM301B0FOJ.40.33.C11.1.454.light.4.raw
tctagcgactcacgaccggtgctcgatttagagtgagctcgttgggtttggggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagccctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccgaagctgaccgtcctaggtcagcccaaggc

SEQ ID NO: 782579 - DNA, 512 bp, Homo sapiens; identical to SEQ ID NO: 679454
  misc_feature: HIJSMM301AMM1H.5.58.F03.1.454.light.4.raw

SEQ ID NO: 782580 - DNA, 504 bp, Homo sapiens
  misc_feature: HIJSMM301EEHYB.22.14.B03.1.454.light.4.raw
  modified_base (417)..(417): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtcctacccgggaatcccggggtccctgaccgattcagtggcagcgggtctgggacagatttcactctcaccatcagcagcctgcaggctgaagatgtggcagtttnttattgtcagcaatattatattcctcctcagacgttcggccaagggaccaaggtaggaaatcaaaacggaactggtggctgcaccta

SEQ ID NO: 782581 - DNA, 495 bp, Homo sapiens
  misc_feature: HIJSMM301EQRDV.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactagaaaatcagcagagtggaggctgaggattggttggggttttattactgcatgcaagctctacaactccttacacttttggccgagggaccaagcgtggagatcaaacgactagt

SEQ ID NO: 782582 - DNA, 488 bp, Homo sapiens
  misc_feature: HIJSMM301A8UZU.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcgagggtccctgaccgattctctggctccaagtctggcacctcagcctccctggtcatcgctgggctccaggctgacgatcgaggctgtatttattattcgccagtcctatgacaacaccctgcgttggttttggtcttgttcggcggcgggacc

SEQ ID NO: 782583 - DNA, 502 bp, Homo sapiens
  misc_feature: HIJSMM301CNV4Y.47.85.H08.1.454.light.4.raw
  modified_base (480)..(480): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacgttctgttgtctcttgggcaactactgttcgtttggtgttcggcggaggaccaagttgaccgtcctaggtcngcccaggctcgccccctcggtc

SEQ ID NO: 782584 - DNA, 508 bp, Homo sapiens
  misc_feature: HIJSMM301D93KC.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtctttcatcttcccgct

SEQ ID NO: 782585 - DNA, 514 bp, Homo sapiens
  misc_feature: HIJSMM301AF70P.17.33.C11.1.454.light.4.raw
  modified_base (476)..(476): a, c, t, g, unknown or other
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctggaggacgaggctgactattactgcctactctactttggtggtgctgtgctagttcggcggagggacaagctgaccgtcttaagtcngcccaaggctcgccccctcggtcacctctcgttccccg

SEQ ID NO: 782586 - DNA, 481 bp, Homo sapiens
  misc_feature: HIJSMM301ARXNG.21.25.C03.1.454.light.4.raw
  modified_base (392)..(392): a, c, t, g, unknown or other
tcgtcgctcgcacgaccggtgctcgatttagtagtgtagatttgggtttgggggctgttcctggaagttgctgataccagtgcacatcaaaaggtgaccccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtacntcgctgggctccaggctgacgatgaggctgattattattgccagtcctatgacacacctgcgtggttttggctgttcggcggcgggacc

SEQ ID NO: 782587 - DNA, 507 bp, Homo sapiens
  misc_feature: HIJSMM301AVJF6.11.67.G01.1.454.light.4.raw
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcgggcggagggaccaagctgaccgtcctgggtcagcccaaggctcgccccctcggtcact

SEQ ID NO: 782588 - DNA, 521 bp, Homo sapiens
  misc_feature: HIJSMM301AWZRD.49.11.A11.1.454.light.4.raw
agtcgagagacacgaccggtgctcgatttagctacgactgcaggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtggggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaaggacggggatgaggccgactattactgtcaggtgtgggatagtggtaggtggtgtcgtcttcggagctgggaccagggtccaccgtcctaggtcagcccaaggcccaaccccactgtcactctcgtcccgccctcctctctctccg

SEQ ID NO: 782589 - DNA, 522 bp, Homo sapiens
  misc_feature: HIJSMM301A6YN8.53.77.G11.1.454.light.4.raw
cgcgtatacacacgaccggtgctcgatttagctagtcactcaagggaaaggggctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtcctaggtcagcccaaggctgccccctcggtcactctgtcccgcctcctctcg

SEQ ID NO: 782590 - DNA, 498 bp, Homo sapiens
  misc_feature: HIJSMM301D3ZGW.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactggttttcggcgggagggaccaagctgaccgtcctaggtcagcccaaggctgccccctcggtcactctgttcccgccctcctcgagtgcgtct

SEQ ID NO: 782591 - DNA, 493 bp, Homo sapiens
  misc_feature: HIJSMM301D4HOR.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgctagtttattactgtcagcagcgtagcaactggcctctcaccttcggcggagggaccaaggtggtagatcaaacgaactagtggctgcaccatctgt

SEQ ID NO: 782592 - DNA, 404 bp, Homo sapiens
  misc_feature: HIJSMM301EKU8P.51.34.D01.1.454.light.4.raw
  modified_base (266)..(266): a, c, t, g, unknown or other
  modified_base (356)..(356): a, c, t, g, unknown or other
  modified_base (358)..(358): a, c, t, g, unknown or other
cgatcgtatacacgaccggtgctcgatttagatcgtctgtgttgggtttgggggtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgaagaccattagcatgtatctgaattggtatcaagacaaaaaaccngggaccaacgtcccctaaactcctagactcctcgatgcactcctactttaggaaaccgacggggtcccatcaaggttcaggtggtaaggngntaccgtgggacagttatttttaacttcacctatcagctaggcttgc

SEQ ID NO: 782593 - DNA, 490 bp, Homo sapiens
  misc_feature: HIJSMM301DI0W0.14.53.E09.1.454.light.4.raw
cgtctagtaccacgaccggtgctcgatttagagagagtgtgttgggtttggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggaccagcagaagccaggccaggcccctctcttgattatatataaggacactgagaggccctcagggatccctgagcgattctctggctccagctcagggacaacactcaccttgaccatcagtgcagtccagacagaagacgaggctgactattattgtcaatcagcagtcagcactaattcttatcgggtgttcggcggagggaccaagctgaccgtccaggtcagcccaaggctgccccctcggt

SEQ ID NO: 782594 - DNA, 491 bp, Homo sapiens
  misc_feature: HIJSMM301ERQ5N.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaacgtcccgctcactttcggcggagggaccaaggtcggagatacgaaacgaactc

SEQ ID NO: 782595 - DNA, 485 bp, Homo sapiens
  misc_feature: HIJSMM301AVOQ7.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatagttggagtttattactgcatgcaagctctacaaactcctctcactttcggcggaggaccgaaggtggagatacaaacgaa

SEQ ID NO: 782596 - DNA, 483 bp, Homo sapiens; identical to SEQ ID NO: 547051
  misc_feature: HIJSMM301ETZKN.46.26.C04.1.454.light.4.raw

SEQ ID NO: 782597 - DNA, 524 bp, Homo sapiens
  misc_feature: HIJSMM301C82QN.48.67.G01.1.454.light.4.raw
agtatacatacacgaccggtgctcgatttagagtatacatattgggtttggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaacgtgaccgtcctgggtcagcccaaggctcggccccctcggtcactctcgttcccaccctcctcta

SEQ ID NO: 782598 - DNA, 490 bp, Homo sapiens; identical to SEQ ID NO: 535234
  misc_feature: HIJSMM301CHO47.17.21.B10.1.454.light.4.raw

SEQ ID NO: 782599 - DNA, 463 bp, Homo sapiens
  misc_feature: HIJSMM301APPOA.18.59.F04.1.454.light.4.raw
tacgagtatgcacgaccggtgctcgatttagtacacacacttagggagttgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcacttctgttcccaccctcctccatactcgta

SEQ ID NO: 782600 - DNA, 521 bp, Homo sapiens
  misc_feature: HIJSMM301EI9AA.8.71.G05.1.454.light.4.raw
  modified_base (370)..(370): a, c, t, g, unknown or other
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctacacaatnaagcagtctcgaacctgaagtattttgcaacttactactgtcaacagacttacaatataccgaggacgttcggtcaagggaccaaggtaggagatacaaacgaactaggtgactgacacatctgtcttcactccttacccgccactctacg

SEQ ID NO: 782601 - DNA, 499 bp, Homo sapiens
  misc_feature: HIJSMM301AFH8U.2.49.E05.1.454.light.4.raw
acgctcgacacacgaccggtgctcgatttagagcgactagcaacacacaaagggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacgggtcaccgtcct

SEQ ID NO: 782602 - DNA, 504 bp, Homo sapiens
  misc_feature: HIJSMM301AHGQL.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattacttgcagctcatatgcaggcagcagcaatgtacttttcggcggagggaccaagctgaccgtcctgggtcagcccaaggctgccccctcggtct

SEQ ID NO: 782603 - DNA, 509 bp, Homo sapiens
  misc_feature: HIJSMM301A11MQ.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcaggcagcaatgtactttcggcggagggacccaagctggaccgtcctgggtcagcccaaggcctcgccccctcggtccta

SEQ ID NO: 782604 - DNA, 447 bp, Homo sapiens; identical to SEQ ID NO: 535201
  misc_feature: HIJSMM301C1XIM.18.9.A09.1.454.light.4.raw

SEQ ID NO: 782605 - DNA, 498 bp, Homo sapiens
  misc_feature: HIJSMM301CK5VX.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgttctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaacggccaacccccactcgtcactt

SEQ ID NO: 782606 - DNA, 479 bp, Homo sapiens; identical to SEQ ID NO: 545213
  misc_feature: HIJSMM301DNJF9.40.59.F04.1.454.light.4.raw

SEQ ID NO: 782607 - DNA, 500 bp, Homo sapiens
  misc_feature: HIJSMM301BBXNC.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgttttatattgtcaacatattctcttgttccgtttaatttcggcggtagggaccaaggtggagatcaaacgactgtggctgcaccatctgtcttcatcttcccgccat

SEQ ID NO: 782608 - DNA, 390 bp, Homo sapiens
  misc_feature: HIJSMM301DM9SD.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctcgttcccgccctcctccgagcgacga

SEQ ID NO: 782609 - DNA, 501 bp, Homo sapiens
  misc_feature: HIJSMM301COBPK.41.35.D02.1.454.light.4.raw
  modified_base (407)..(407): a, c, t, g, unknown or other
  modified_base (492)..(492): a, c, t, g, unknown or other
tctatactatcacgaccggtgctcgatttagcacacgatagttgggtttgggggctttgcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgaccatctctgggctccaggctgaggacgaggctgactattactgcagttcatatacaagcagcaggcacnggagtcttcggaactgggaccagggtcaccgtcctaggtcagccccaaggccaaccccactgtcactctgttcccacctccctcntagtataga

SEQ ID NO: 782610 - DNA, 483 bp, Homo sapiens
  misc_feature: HIJSMM301CHCZZ.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggaagggccaaggtggagatcaaacgaactagtggctgcaccat

SEQ ID NO: 782611 - DNA, 494 bp, Homo sapiens
  misc_feature: HIJSMM301EH2E5.17.26.C04.1.454.light.4.raw
cgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtacaacagagttacaatacccctcggcctcactttcggcggtagggaccgaaggtggacgatacaaaacgaactacgtggctgcacc

SEQ ID NO: 782612 - DNA, 502 bp, Homo sapiens; identical to SEQ ID NO: 624713
  misc_feature: HIJSMM301AD4E0.12.86.H09.1.454.light.4.raw

SEQ ID NO: 782613 - DNA, 484 bp, Homo sapiens
  misc_feature: HIJSMM301A90BO.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtgcagtggatcaggcacagattttacactgaaaatcagcagagtggaggctgaggatggttgggctctattattgcatgcaagctctacaagtcccgctcactttcggcggagggaccaaggtggagatcaaacgaa

SEQ ID NO: 782614 - DNA, 512 bp, Homo sapiens
  misc_feature: HIJSMM301ARFFJ.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctcctaaccatctctgggctccagtttgaggacgagtctacttattactgcagttcctttaattaggcgccactctcgtggttttcggcggaggcaccgaagtgaccgtcctcggtcacgccaaggctgccccctcggtcactc

SEQ ID NO: 782615 - DNA, 460 bp, Homo sapiens; identical to SEQ ID NO: 536053
  misc_feature: HIJSMM301AI3D0.22.28.C06.1.454.light.4.raw

SEQ ID NO: 782616 - DNA, 495 bp, Homo sapiens
  misc_feature: HIJSMM301A3JT2.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgctactttattactgtcagcagcgtagcaactggcctctcactttcggcggagggaccgaggggtggagatcagacgaactggtggctgcaccatctgt

SEQ ID NO: 782617 - DNA, 506 bp, Homo sapiens
  misc_feature: HIJSMM301BSQCH.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgagacgaggctgattacttctgttgctcttgggcaactactgtcgtttgggtgttcggcggagggaccaagttgaccgtcctaggtcagcccaaggctgccccctcggtcact

SEQ ID NO: 782618 - DNA, 530 bp, Homo sapiens
  misc_feature: HIJSMM301DAI65.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccgacgctgaccgtcctacggtcagcccaaggctcgccccctccggtcactctcgttcccgaccctcctccgagtaacg

SEQ ID NO: 782619 - DNA, 518 bp, Homo sapiens
  misc_feature: HIJSMM301EP5L7.9.12.B01.1.454.light.4.raw
  modified_base (424)..(424): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacngttttctcgggcgttcggccaaggacctaacggaggtaagtacaaaccgaacgtaagtggtctggcaaccactctcgtctccttatcttccccg

SEQ ID NO: 782620 - DNA, 512 bp, Homo sapiens
  misc_feature: HIJSMM301EBC1Q.17.41.D08.1.454.light.4.raw
  modified_base (244)..(244): a, c, t, g, unknown or other
cgtagactagcacgaccggtgctcgatttagtcacgcgagaaagggaaagggggaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactntttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatccttcccgccatc

SEQ ID NO: 782621 - DNA, 556 bp, Homo sapiens
  misc_feature: HIJSMM301AOJ7W.22.21.B10.1.454.light.4.raw
acatacgcgtcacgaccggtgctcgattttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcgaggggtccctgatcgcttctctggctccaagtctggcgacacggcctccctgaccgtctctgggctccagctgaggatgaggctgattattactgctactcatatgcaggcggcaaccttcgttgggggttcgtttcggggaccgggtaggggaacccaaaggccttcggacccggttcccgtaaggtccaggcccccgaaaggccttcgcccccccttcgggtcctacctccttcccg

SEQ ID NO: 782622 - DNA, 496 bp, Homo sapiens
  misc_feature: HIJSMM301AGH6R.40.83.H06.1.454.light.4.raw
tctagcgactcacgaccggtgctcgatttagatcacgtgcgtcggcgggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcaggcctcagtgaattggggtgtttcgggcgggaaggggacccaaacgtcgtcccgtcctagggtcc

SEQ ID NO: 782623 - DNA, 507 bp, Homo sapiens
  misc_feature: HIJSMM301B3C61.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctgaggacgaggctgattattactgcagctcatataccagcaccagcactctctatgtcttcggaacgtggaccaaggtccaccgtccgtagtcacggcccaacggacccc

SEQ ID NO: 782624 - DNA, 500 bp, Homo sapiens
  misc_feature: HIJSMM301AHBXP.48.63.F08.1.454.light.4.raw
agtatacatacacgaccggtgctcgatttagcgatcgtataaggggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgctaacttattactgtcaacaatattatacttacccgtactacttttggccaggggactaagctaggagatcgaacgaactgtggctgcaccatctgtcttcatccttccccg

SEQ ID NO: 782625 - DNA, 500 bp, Homo sapiens
  misc_feature: HIJSMM301AZKD7.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtatttactgtcagcagtatcataaggtcaaacaccttcggccaagggacacgactggagattaaaggaactgtggctgacaccactctgtcttcatccttccccg

SEQ ID NO: 782626 - DNA, 528 bp, Homo sapiens
  misc_feature: HIJSMM301CBENG.3.87.H10.1.454.light.4.raw
agacgcactccacgaccggtgctcgatttagcagtactgcgttgggtttggggggggtctcaggaggcagcgctctcgggacgtctccaccatggcctgggttctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagacttaaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggtagggaccaaggcagaccgtcctaggtcagcccaaggcctgccccctcggtccactctccg

SEQ ID NO: 782627 - DNA, 484 bp, Homo sapiens
  misc_feature: HIJSMM301BX2N3.40.1.A01.1.454.light.4.raw
tctagcgactcacgaccggtgctcgatttagacgtctcatcagggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatacagcagcctgcagccagaagatattgcgacatatttctgtcaggtgtatgaagtctcccttgttttcggtccaggggaccgaaggtagggagatacaaacgaacctaggtggctcgcaccat

SEQ ID NO: 782628 - DNA, 523 bp, Homo sapiens
  misc_feature: HIJSMM301BE7T5.12.53.E09.1.454.light.4.raw
  modified_base (425)..(425): a, c, t, g, unknown or other
atacgacgtacacgaccggtgctcgatttagagagagtgtgttgggtttgggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctctaggggtttcttatcgcttctctggctccgagtctggcaacacggcctccctgaccaatctctgggctccaggctgaggacgaggcggattattactgttnctcatatgcgggtagtagcaactttcgatgtcctagttcggcgggagggaccaaggctcgaccgtcctcgggtcagccccaaggcctcgccccctccc

SEQ ID NO: 782629 - DNA, 493 bp, Homo sapiens
  misc_feature: HIJSMM301CAZCS.14.55.E11.1.454.light.4.raw
  modified_base (491)..(491): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcgggagggaccgaaggcggagatcagacgactagtggcctgcaccatctgtcttnta

SEQ ID NO: 782630 - DNA, 499 bp, Homo sapiens
  misc_feature: HIJSMM301DBBO5.3.10.A10.1.454.light.4.raw
  modified_base (493)..(493): a, c, t, g, unknown or other
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcgagggacaacagtcacgttgaccatcagtggagtccaggcagaggacgaggactgactattattgtcaatcagcagacaacagtaatacttatctttatgtcttcgatctgggaccagggtctaccgtccgtagtcacgcccaacggcccaaaccccncttacg

SEQ ID NO: 782631 - DNA, 502 bp, Homo sapiens
  misc_feature: HIJSMM301DV87A.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgctagtttattactgtcagcaagcgtagcaactccctcacgttcggcggagggaccaaggtggagatcaaacgaactagtggactgcaccatctagtcttcatccttcccgcct

SEQ ID NO: 782632 - DNA, 529 bp, Homo sapiens
  misc_feature: HIJSMM301BSMH2.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaactttggtttatcaggcaataagcggcctcagggtttctaatcgcttctctggctccaagtctgcaacacggccgccctgacaatctctgggctccagctgacgacgaggctgtatttttactgtctgctcatatgcaggtgatcactactttttattgttcgggacgtcgggaccgaaaggtccaaccgtccctacggtcaacgcccaacggacccaaccccaacctgtcactccttccg

SEQ ID NO: 782633 - DNA, 494 bp, Homo sapiens
  misc_feature: HIJSMM301AHS8B.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccggggtccctgaccgattcagtggcaggcgggtctgggacagatttcactctcaccatcagcagcctgcaggctgaagatgcggcagtttatactgtcagcactattatacgtaccccattcacattccggccctgggaccaaaggtggagatacaaacgactgtgg

SEQ ID NO: 782634 - DNA, 491 bp, Homo sapiens
  misc_feature: HIJSMM301BPJ4H.10.72.G06.1.454.light.4.raw
catagtagtgcacgaccggtgctcgatttagctacgactgcaaggggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggccccagactcatcatttctgatgtcagtgatcggccctttgggatttctaatcgcttctctgcctccaagtctggcaacacggcttccctgaccatctccgggctccacgctgaggacgaggctcattattacttgcagctcatatacacccaggggccactctcgtggatattcggcggagggacctggctgaccgtcctagtcagcccaa

SEQ ID NO: 782635 - DNA, 449 bp, Homo sapiens
  misc_feature: HIJSMM301EXRPT.18.9.A09.1.454.light.4.raw
tacgagtatgcacgaccggtgctcgatttagcgagacgcgcagggtccgtgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactaggctccaggctgaggatgaggctgactattactgccagtcctatgacatgaggctggagtggttcgtatgtcttcggatctgggaccaaggtcaccgtcctaagtcagcccaaggccaacccctctgtcactctgttcccgccctcctccatactcgta

SEQ ID NO: 782636 - DNA, 472 bp, Homo sapiens
  misc_feature: HIJSMM301BJ53U.49.62.F07.1.454.light.4.raw
  modified_base (464)..(464): a, c, t, g, unknown or other
agtcgagagacacgaccggtgctcgatttagtagtcgcataaagggaaagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctcgtgggacagattttaactttcaccatcagcaggctgcagcctgaagatattgcaacatattactgtcaacagtatgatcgtctcccgctcacgtttcggcgggggaccaagggtggagancaagcgaa

SEQ ID NO: 782637 - DNA, 519 bp, Homo sapiens
  misc_feature: HIJSMM301AQ0RR.7.71.G05.1.454.light.4.raw
  modified_base (434)..(434): a, c, t, g, unknown or other
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagactttcactctcaccatcatcagcctggagcctgaagatgttgctagtttattactgtctaacatcgtaaccgngtggcctccgggggccactttcggcccttgggaccaaacggtaggagttaatcaaacgaactcgtaggctgcaccatctgtcttt

SEQ ID NO: 782638 - DNA, 508 bp, Homo sapiens
  misc_feature: HIJSMM301BC83I.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacagttttctcgggcgtcggtccaagggaccaaggtggaaatacaaacgaacagtggctgcgaccatctgtcttcacttcttcccccg

SEQ ID NO: 782639 - DNA, 509 bp, Homo sapiens; identical to SEQ ID NO: 539359
  misc_feature: HIJSMM301DUD4W.47.85.H08.1.454.light.4.raw

SEQ ID NO: 782640 - DNA, 507 bp, Homo sapiens
  misc_feature: HIJSMM301C2WIF.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctacggtcagcccaaggccaacccactgtcta

SEQ ID NO: 782641 - DNA, 482 bp, Homo sapiens
  misc_feature: HIJSMM301BZ0SN.5.36.D03.1.454.light.4.raw
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctcttatctctgatgcctccaatttgcacagtggggtcccaccaacgttcagcggcagtggatctgggacagagttcactctcaccatcagcagcctgcagcctgacgatggtggcaactttatactggccaacagtatgaatacgttattggaccgttggcctaaggggaaccaagagtaagaaatctaaacgaactgtgg

SEQ ID NO: 782642 - DNA, 519 bp, Homo sapiens
  misc_feature: HIJSMM301D3PQP.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctgggtcccagacagattcagcggcagtggcactgatgtcacactgacaatcagcagggtggaggctgaggatggttggggtttgttcctccatgcaaggtacacactcggtccttttggccgtacgggggacccgaaaccgtggaagaagtacaaaatggaaactggtggcgtcgaccaccatcgttcgtcttt

SEQ ID NO: 782643 - DNA, 502 bp, Homo sapiens
  misc_feature: HIJSMM301E0UKC.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcacctttcggcccaagggacacggactggagattaaacgaactgtaggctgcaccatctgtcttcattccc

SEQ ID NO: 782644 - DNA, 487 bp, Homo sapiens
  misc_feature: HIJSMM301AYMJS.8.53.E09.1.454.light.4.raw
ctcgcgtgtccacgaccggtgctcgatttagagagagtgtgttggggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggcctcaggggtctctgaccgattctctgcctccaagtctggcacttctgcctccctggtcatatctggtctccagggtgaggatgaggctggtattattactgccaacttccgtatcgacaacagcctgagtatttggcttgttcggcggcgggtac

SEQ ID NO: 782645 - DNA, 508 bp, Homo sapiens
  misc_feature: HIJSMM301C34NM.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtctcggaactgggaccaaggtcaccgtcctaggtcagcccaaggcccaaccccactgtcta

SEQ ID NO: 782646 - DNA, 489 bp, Homo sapiens
  misc_feature: HIJSMM301AWIWL.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggtctaatcgggcctccggggtccctgacaggttcagtggcagtggatcaggcacagattttacactagaaaatcagcagagtggaggctgaggatgttgggctctattattgcatgacaagctcgtacaagtcccgctctacttcggtcggagggaccaaggtaggagatacaaacgaa

SEQ ID NO: 782647 - DNA, 501 bp, Homo sapiens
  misc_feature: HIJSMM301CZVNW.26.26.C04.1.454.light.4.raw
  modified_base (492)..(492): a, c, t, g, unknown or other
  modified_base (495)..(495): a, c, t, g, unknown or other
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagtagaggccaggccaacctccgaggcgcctaatttataagatttctaatcgggattccggggtcccagacagattcagcggcagtgggtcaggcactgatttcacgctgaagatcagcagggtggaggctgaggatgttgcggttttattactgcctgcagagtattcactcggccgtggcgttacggccgaacgggacaaggtaggaatacaaacgactgngcngcacat

SEQ ID NO: 782648 - DNA, 456 bp, Homo sapiens
  misc_feature: HIJSMM301CLH6B.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttcggcggagggaccaagctgaccgtctaagtcagcgcaaggctcgccccctcggtccactctcgttccccaccctcctccacgagagta

SEQ ID NO: 782649 - DNA, 507 bp, Homo sapiens
  misc_feature: HIJSMM301A3I17.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctcctgggctccagactgaggatgaggctgactattactgcagctcatttgcagctagccgtatactcttcggcggagggaccaagctgaccgtcctaggtcagcccaaggcctcgccccctcggtcct

SEQ ID NO: 782650 - DNA, 519 bp, Homo sapiens
  misc_feature: HIJSMM301AIJSQ.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgttggtttcggcggaggcaccgaagtgaccgtcctcggtcagcccaaggctcgccccctggtccactcttccg

SEQ ID NO: 782651 - DNA, 520 bp, Homo sapiens
  misc_feature: HIJSMM301EVAHU.43.81.H04.1.454.light.4.raw
  modified_base (514)..(514): a, c, t, g, unknown or other
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttggggcaaagctgccctgacactgtcaggtgtgcaccctgaggacgaggctgagtattactgtctgctccactttcgtactgcctgggtcttcggcgggggactcagttgaccgtccgtaggtccagcccaaggctgccccctcggtcactctcgttcccaccctccnccacta

SEQ ID NO: 782652 - DNA, 469 bp, Homo sapiens
  misc_feature: HIJSMM301AT6VM.41.81.H04.1.454.light.4.raw
  modified_base (395)..(395): a, c, t, g, unknown or other
tctatactatcacgaccggtgctcgatttagtagtgtagattcgcgggggcaggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaggaaaagcccctcagctcctcatctgtactgcatccactttacaaagtggggtcccatcaaggttcagcggcagtggatctggcacagatttcactctcaccatcagcagcctgcagcctgaagattttgnacttattactgtctacagattacaattaccctcgtaccttttggtccaggggaccaggctggagatcaaacgaa

SEQ ID NO: 782653 - DNA, 514 bp, Homo sapiens
  misc_feature: HIJSMM301AWT00.5.59.F04.1.454.light.4.raw
atcagacacgcacgaccggtgctcgatttagtacacacacttagggattggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgtcgccgaacggacgaaggtaggaatacaaacgaactagtacggtcgtgtcaccatctagttcttctacttcttccccg

SEQ ID NO: 782654 - DNA, 486 bp, Homo sapiens
  misc_feature: HIJSMM301CAPBZ.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccacgggccactggtttcccagccaggttcagtggcagtgcgtctgcgacagagttcactctcaccatcaacagcctgcagtctgaagattttgctagtttattactgtcagcagtatcatgactggccgctcaccttccggccaagggacacgactggagattaaacgactgtggctgcaccat

SEQ ID NO: 782655 - DNA, 508 bp, Homo sapiens
  misc_feature: HIJSMM301BECIV.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcaggtgggagcaacgttcggggtgttcgggcggagggaccaagctgaccgtcctaggtcacgaccccg

SEQ ID NO: 782656 - DNA, 474 bp, Homo sapiens
  misc_feature: HIJSMM301CLM7R.8.53.E09.1.454.light.4.raw
  modified_base (408)..(408): a, c, t, g, unknown or other
ctcgcgtgtccacgaccggtgctcgatttagagagagtgtgttggggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctcctggtcatatctggtctcagggtnaggatgaggctgattatactgccactctatgacaacagcctgagtattggctgttcggcgcgggac

SEQ ID NO: 782657 - DNA, 499 bp, Homo sapiens
  misc_feature: HIJSMM301CNUMH.18.59.F04.1.454.light.4.raw
tacgagtatgcacgaccggtgctcgatttagtacacacacttagggattggggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaa

SEQ ID NO: 782658 - DNA, 512 bp, Homo sapiens; identical to SEQ ID NO: 629316
  misc_feature: HIJSMM301D3XZS.5.27.C05.1.454.light.4.raw

SEQ ID NO: 782659 - DNA, 498 bp, Homo sapiens; identical to SEQ ID NO: 555873
  misc_feature: HIJSMM301A3NTX.3.71.G05.1.454.light.4.raw

SEQ ID NO: 782660 - DNA, 506 bp, Homo sapiens
  misc_feature: HIJSMM301B3L6P.22.5.A05.1.454.light.4.raw
  modified_base (503)..(503): a, c, t, g, unknown or other
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgctagtttattactgtcagcagcgtagcaactccctcacgttcggcggagggaccgaaggtggagatacaaacgaactgtggcgtgcaccatctgtcttcactcttacccgccnctt

SEQ ID NO: 782661 - DNA, 477 bp, Homo sapiens
  misc_feature: HIJSMM301D63DA.41.5.A05.1.454.light.4.raw
tctatactatcacgaccggtgctcgatttagatagatagacagggggcaggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcgccaaggacacgactggacattaaacaactgtggctgcacca

SEQ ID NO: 782662 - DNA, 485 bp, Homo sapiens
  misc_feature: HIJSMM301BY4KN.21.25.C03.1.454.light.4.raw
  modified_base (420)..(420): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcgacggggtccctgaccgattctctggctccaagtctcggcacctcacgcctccctggtcatcgctgggctccagctgacgatgagntgattattattgcagtcctatgacaacacctgtcgtggttttggtcttgttcggtcggcgggacc

SEQ ID NO: 782663 - DNA, 504 bp, Homo sapiens
  misc_feature: HIJSMM301BF0CW.43.35.D02.1.454.light.4.raw
tgtgagtagtcacgaccggtgctcgatttagcacacgatagttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaagtttggtgttcggcggagggaccgagctgaccgtctaggtcagcccaggctgccccctcggt

SEQ ID NO: 782664 - DNA, 494 bp, Homo sapiens
  misc_feature: HIJSMM301B8WNE.10.72.G06.1.454.light.4.raw
catagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctcaagtctggcaacacggcttccctgaccatctccgggctccacgctgaggacgaggctcattattactgcagctcatactacacccaggggcactctcgtgattagttcgggcggtaagggcctggctcggaccgtcctacgtcacg

SEQ ID NO: 782665 - DNA, 521 bp, Homo sapiens
  misc_feature: HIJSMM301EM35I.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacactatttccacccctcaccatcaatagcctggaagctgaagatgctgacaacttattactgtcatcagatacttactttacctcgaagtgactcaacccttcggaccaacggggaccaacgactggagtaattaaaaccgg

SEQ ID NO: 782666 - DNA, 522 bp, Homo sapiens
  misc_feature: HIJSMM301DC53A.15.34.D01.1.454.light.4.raw
  modified_base (474)..(474): a, c, t, g, unknown or other
  modified_base (514)..(514): a, c, t, g, unknown or other
  modified_base (517)..(517): a, c, t, g, unknown or other
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgttggggcgtggcatttggtgttcggtcggagggacgaaacgngaccgtcctaggtcagcccaaggctcgccccctcggtccnctnttccg

SEQ ID NO: 782667 - DNA, 463 bp, Homo sapiens
  misc_feature: HIJSMM301EE3XR.16.4.A04.1.454.light.4.raw
  modified_base (455)..(455): a, c, t, g, unknown or other
tgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtgggtcccatcaagattcagcggcagtggatctgggacagagttcactctcaccatcagcagcctgcagcctgatgattttgcaacctattattgccaacagtatatagtatcgtgacgtcgcaggacaggtgacatcaaacgactagtgntgcactac

SEQ ID NO: 782668 - DNA, 479 bp, Homo sapiens
  misc_feature: HIJSMM301EEXIR.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggcctgggaccaatgtggatatcaaaccgaactgtggctgcaccatct

SEQ ID NO: 782669 - DNA, 487 bp, Homo sapiens
  misc_feature: HIJSMM301DXRCH.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagtattttgctagttttattactgtcagcagtatcataactgccgctcaccttcggccaagggacacgactggagattaaacgaactgtggctgcaccat

SEQ ID NO: 782670 - DNA, 499 bp, Homo sapiens; identical to SEQ ID NO: 758728
  misc_feature: HIJSMM301BL0FN.2.49.E05.1.454.light.4.raw

SEQ ID NO: 782671 - DNA, 503 bp, Homo sapiens
  misc_feature: HIJSMM301B287V.17.61.F06.1.454.light.4.raw
  modified_base (462)..(462): a, c, t, g, unknown or other
cgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctccctgaccatctctgggctccaggctgaggacgaggctgattattactgcagctcatatacaagcagcagcactccttgggtnttcggcggagggaccaagctgaccgtcctaggtcagcccaa

SEQ ID NO: 782672 - DNA, 498 bp, Homo sapiens; identical to SEQ ID NO: 589415
  misc_feature: HIJSMM301ALMCZ.16.78.H01.1.454.light.4.raw

SEQ ID NO: 782673 - DNA, 484 bp, Homo sapiens
  misc_feature: HIJSMM301ATWCC.4.57.F02.1.454.light.4.raw
  modified_base (479)..(479): a, c, t, g, unknown or other
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctaacaacctgaagattttgcaacttactactgtcaacagagttacgatacccctccgctacacttcggcggaggaccaaggtaggagatcaaacgactgtgcngcacc

SEQ ID NO: 782674 - DNA, 504 bp, Homo sapiens
  misc_feature: HIJSMM301CR0KQ.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactccccgtggtacttcggcggagggaccaaggtgaccgtcctaggtcagcccaaggctgccccc

SEQ ID NO: 782675 - DNA, 495 bp, Homo sapiens
  misc_feature: HIJSMM301EPL2F.12.27.C05.1.454.light.4.raw
atacgacgtacacgaccggtgctcgatttagacgcgatcgaagggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacggccaacatcacctgctctggagataaattggggcataaatatgtctgctggtatcaacagaaggcaggccagtcccctgtggttatcatctatcaagataacaagcggccctcagggatccctgagcgattctctggctccaactctgggaacacagccactctgaccatcagcgggacccaggctctcgatgaggctgactattactgccaggcgtggacagctccacttcccgttatgtcttcggaggtagggacatggtcaccgtcctaggtcagcccaagacccaacccactcg

SEQ ID NO: 782676 - DNA, 505 bp, Homo sapiens
  misc_feature: HIJSMM301AH2VQ.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgctaggcagccgtatctcttcggcggagggaccaagctgaccgtcctaggtcagacccaaggctcgcccctcgg

SEQ ID NO: 782677 - DNA, 483 bp, Homo sapiens
  misc_feature: HIJSMM301B9YNO.10.35.D02.1.454.light.4.raw
catagtagtgcacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgactgtggctgcacc

SEQ ID NO: 782678 - DNA, 487 bp, Homo sapiens
  misc_feature: HIJSMM301EQAWY.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatcgtgggaccagggtcaccgtcctaggtcagcccgaagcccaa

SEQ ID NO: 782679 - DNA, 482 bp, Homo sapiens
  misc_feature: HIJSMM301ARFJE.13.76.G10.1.454.light.4.raw
tcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactcctcatcaatagtaacaacaatcggcccgcaggggtccctgaccgattctctggctccaggtctggcacctcagcctccctggtcatcactcggctccaggctgaggatgaggctgattatttctgccagtcctatgacagcacgcctgagtgcttcggtagttcgggcggggggacccgac

SEQ ID NO: 782680 - DNA, 447 bp, Homo sapiens; identical to SEQ ID NO: 535201
  misc_feature: HIJSMM301B1LTE.18.9.A09.1.454.light.4.raw

SEQ ID NO: 782681 - DNA, 512 bp, Homo sapiens
  misc_feature: HIJSMM301AWCGM.18.78.H01.1.454.light.4.raw
tacgagtatgcacgaccggtgctcgatttagtgtgagtagtttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccgaggctgaggacgaggctgattattactgcagctcatatacaagcaccagcactctcttattgtcttcggaactgggaccaaggtccaccgtcctaggtcacgcccaacggacccaaccca

SEQ ID NO: 782682 - DNA, 502 bp, Homo sapiens
  misc_feature: HIJSMM301CGI05.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtctaggtcagcccaaggccaacccactgtcta

SEQ ID NO: 782683 - DNA, 479 bp, Homo sapiens
  misc_feature: HIJSMM301AQ9T3.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactagttactgtcaggcgtgggacagcagcactcgcccgctatgtcttcggaactgggaccaaggtcaccgtcctaagtccagaccccg

SEQ ID NO: 782684 - DNA, 450 bp, Homo sapiens
  misc_feature: HIJSMM301CBGS2.51.85.H08.1.454.light.4.raw
  modified_base (388)..(388): a, c, t, g, unknown or other
cgatcgtatacacgaccggtgctcgatttagtatcactcagtcgcagggtcctgggcccagtctgtcctgactcagccaccctcagcgtctgggacccccgggcggagggtcgccatctcttgttctggaagcagctccaacatcggaagtaatgctgtcaactggtatcaacaactcccaggatcggcccccagactcctcatttttaataatgatcagcgggcctcaggggtccctgaccgattctctgcctccaagtcaggcacctcagcctccctggccatcagtgggctccagtctgaggatgaggctgattattattgtgcagcgtgggatggacagcctgtatatgtctctcttcggaggaggcacccagctgaccgtccncggtcagcccaaggctcgccccctcggtccactctcgttcccaccctcctctcgtacgcact

SEQ ID NO: 782685 - DNA, 492 bp, Homo sapiens
  misc_feature: HIJSMM301C8FYY.49.81.H04.1.454.light.4.raw
agtcgagagacacgaccggtgctcgatttagtagtgtagattcgcgggcgtagactttgtgtttctcgtagtctccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaactcctgatctacgatgcatccaatttggaaataggggtcccatcaaggttcagtggaagtggatctgggacgtattttactttcaccatcatcaacctgcagcctgaggatattgcaacataattactgtcaacaatatgataatctaccactcactttacggcggagggaccacggttggagagtacaaacgaactaggtggctgcaccatctgtcttcactcttcccgcc

SEQ ID NO: 782686 - DNA, 481 bp, Homo sapiens
  misc_feature: HIJSMM301BZ8ZX.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagccccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatcaaacgaactgtggctgcacatctcg

SEQ ID NO: 782687 - DNA, 512 bp, Homo sapiens
  misc_feature: HIJSMM301ASNJS.49.38.D05.1.454.light.4.raw
agtcgagagacacgaccggtgctcgatttagtatctgatagttgggtttggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattacgtactgttactcaacagacattactactactcatagggtgttcggcggagggaccaagctgaccgtcctaggtcagcccaaggctgccccctcggcactctgttcccaccctt

SEQ ID NO: 782688 - DNA, 490 bp, Homo sapiens
  misc_feature: HIJSMM301BP6ED.40.8.A08.1.454.light.4.raw
tctagcgactcacgaccggtgctcgatttagcatactctacagggggctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcaacaatattatactactccgctcactttcggcggaggcaccaaggtggaagatcaggacaactgtggctagca

SEQ ID NO: 782689 - DNA, 479 bp, Homo sapiens
  misc_feature: HIJSMM301B8TZ3.40.23.C01.1.454.light.4.raw
tctagcgactcacgaccggtgctcgatttagtacacgtgattagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagccgggaccaggctatggatgagctgactattactgtcaggcgtgggacatcagcagtggaggttggtttcggcggagggaccaagctgaccgtctaagtcagaccccg

SEQ ID NO: 782690 - DNA, 516 bp, Homo sapiens
  misc_feature: HIJSMM301DW9LP.17.33.C11.1.454.light.4.raw
  modified_base (443)..(443): a, c, t, g, unknown or other
  modified_base (456)..(456): a, c, t, g, unknown or other
cgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctatcggngggaggacaagcngcgtcttaagtcagcccaagcctcgccccctcggtccactcctgttccccgccctccctt

SEQ ID NO: 782691 - DNA, 500 bp, Homo sapiens; identical to SEQ ID NO: 650924
  misc_feature: HIJSMM301B6Q72.41.53.E09.1.454.light.4.raw

SEQ ID NO: 782692 - DNA, 514 bp, Homo sapiens
  misc_feature: HIJSMM301ECJZ1.7.34.D01.1.454.light.4.raw
  modified_base (451)..(451): a, c, t, g, unknown or other
  modified_base (457)..(457): a, c, t, g, unknown or other
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacgagggacagcattatttgggtnttcggnggagggaccaagctgaccgtcctgcgtcagcccaaggcctgcccccgtcggtcactt

SEQ ID NO: 782693 - DNA, 483 bp, Homo sapiens
  misc_feature: HIJSMM301AVLZU.16.86.H09.1.454.light.4.raw
tgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaaacagcactctcgactggtattcggcggaggggaccaagctgaccgtcctaggtcagcccaaggctgccccctcggtcactctgttccccaccctcctcgagtacgtaca

SEQ ID NO: 782694 - DNA, 487 bp, Homo sapiens
  misc_feature: HIJSMM301BVBE0.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactagaaaatcagcagagtggaggctgaggatgttgggctctattattgcatgcaagctctacaagtcccgctcactttcggcggagggaccgaaggtggagagtcaaacgaa

SEQ ID NO: 782695 - DNA, 488 bp, Homo sapiens
  misc_feature: HIJSMM301APWG3.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcacgtgggtcagacactgatttcacactgaaaatcagcagggtggaggctgaggatggtcggggtttactactgcatgcagggtacactctggccgttcacttttggtcaggggaaccaaactggaatatcagacgaatgtgg

SEQ ID NO: 782696 - DNA, 523 bp, Homo sapiens
  misc_feature: HIJSMM301DO9NW.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaaggcccccaaactcttgatttatgatgtctctaatcggccctccggcgtttctattcgcttctctggctccaagtctggcaacacggcctccctgaccatctctggactccagactgaggacgagggctgatttattactgctgctcatatacaggggacagcattatttgggtggtttcggcgggagggacccaagctcgaccgtcctgcgtcagcccaaggctcgccccctcggtcactccg

SEQ ID NO: 782697 - DNA, 490 bp, Homo sapiens
  misc_feature: HIJSMM301B0YJJ.21.4.A04.1.454.light.4.raw
tcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagtatttcgcagtgtattactgtcagcagtatggaagttcacctctgtcgttcggaccaagggaccaaggtagaaatgaaacgaactgtggctgcaccat

SEQ ID NO: 782698 - DNA, 521 bp, Homo sapiens
  misc_feature: HIJSMM301E01R0.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacactgggtgttcggcggagggaccgaggctgaccgtcctaggtcagccaaggctgccccctcggtcactctgttcccaccctt

SEQ ID NO: 782699 - DNA, 490 bp, Homo sapiens
  misc_feature: HIJSMM301D4AIY.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaattttattactgttcagcaatataatacctggcctccgctcactttcggcggagggaccaaggttgagatcaaacgactgtggctgcaccta

SEQ ID NO: 782700 - DNA, 503 bp, Homo sapiens
  misc_feature: HIJSMM301BEN1N.2.35.D02.1.454.light.4.raw
  modified_base (464)..(464): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtattttcggcggagggaccaagcngaccgtccctggtcagcccaaggctgccccctcggtcta

SEQ ID NO: 782701 - DNA, 534 bp, Homo sapiens
  misc_feature: HIJSMM301B1AEM.9.65.F10.1.454.light.4.raw
tgatacgtctcacgaccggtgctcgatttagctacgctctaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagaagtgacgttggtggttctgactctgtctcctggtaccaacaacacccaggccaaacccccaagctcatgatttatgatgtcaatcatcggccctcaggggtttctgatcgcttctctggctccaagtccggcaacacggcctccctgaccgtctctgggctccagactgacgacgaggctgattatttctgctcctcatatacaaggggcagcactctcgtactagttcgggacggagggaccaaggctcgacccgttcctggggttccaaggccccgaaaggcctcggccccccgttggtccacttcttcccg

SEQ ID NO: 782702 - DNA, 526 bp, Homo sapiens
  misc_feature: HIJSMM301DBYYV.7.34.D01.1.454.light.4.raw
  modified_base (362)..(362): a, c, t, g, unknown or other
cgtgtctctacacgaccggtgctcgatttagatcgtctgtgttggggtttgggggggggtctcaggaggcagcgctctcgggacgtctccaccatggcctgggctctgctattcctctccttcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctcggcgtttctattcgcttctctggctcaagtctggcaacncggcctccctgaccatctctggactccagactgaggacgaggctgattattactgctgctcatatacaggggacaaggcatttatttgggttggttcggcggagggaccaaggctgaccgtcctggcgtcagcccgaaggcctcgccccctcggtccacttccg

SEQ ID NO: 782703 - DNA, 490 bp, Homo sapiens
  misc_feature: HIJSMM301D97YZ.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcgaggacttatgtcttcggaacgtgggacccacgttaccgtcctaggtcagaccccg

SEQ ID NO: 782704 - DNA, 504 bp, Homo sapiens
  misc_feature: HIJSMM301EUOAT.51.60.F05.1.454.light.4.raw
cgatcgtatacacgaccggtgctcgatttagtacgtcatcagggaaagggggaagagctgctcagttaggacccagagggaaccatggaaaccccagcgcagcttctcttcctcctgctactctggctcccagatactaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagatttgctaatttattactgtcagcagcgtagcaattggcctccctcgatcaccttcggccaagggacacgactggagaataaacgaactgtggctgcaccatctgtcttcacttcc

SEQ ID NO: 782705 - DNA, 487 bp, Homo sapiens
  misc_feature: HIJSMM301AS1MP.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatcccctgagcgattctctggctccagctcagggacaacagtcacgttgaccatcagtggagtccaggcagaggacgaggctgactattattgtcaatcagcagacaacagtaatacttatctttatgtcttcggattcgtgggaccagggtcaccggtcctaggtcagccccaaagg

SEQ ID NO: 782706 - DNA, 437 bp, Homo sapiens
  misc_feature: HIJSMM301ASW74.17.11.A11.1.454.light.4.raw
cgtagactagcacgaccggtgctcgatttagctacgactgcggggtctctgcatctagtagggccgatctctgcgctcctgacggtgctcgcctttatccatttttccaggtcctccacgtcctcctcttcttcctcccatctgttccatcaaaggtccagggggcccccagggccacctcgtcttcctccaccaaagccacctcggtccatgccccggccaccacggaagccacctctgtctccaccacggccacctctgaacattccaccgggaccaccacgatccatgaggccacctcttcctccccgcatgccaccagggccacctctgccacgatcaccacccgggggcggaaagggtggcgggaggaagccttcaggctttggggccttacactggttgcactctgttccccacctccctcctagtctacg

SEQ ID NO: 782707 - DNA, 485 bp, Homo sapiens
  misc_feature: HIJSMM301CGJUI.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctcgcccccg

SEQ ID NO: 782708 - DNA, 523 bp, Homo sapiens
  misc_feature: HIJSMM301EP2FQ.40.48.E04.1.454.light.4.raw
tctagcgactcacgaccggtgctcgatttagagagcgtcacagagagaaggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcgggcggggggaccaagcgtggaccgtccgtacggtcacgacccaaggctccgccccgtccggtcaccttcg

SEQ ID NO: 782709 - DNA, 467 bp, Homo sapiens
  misc_feature: HIJSMM301CU0SP.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaacaggaaaagccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcggccctggactgaagtgcatatgaagagaactgtgg

SEQ ID NO: 782710 - DNA, 503 bp, Homo sapiens
  misc_feature: HIJSMM301E226Y.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctcctgaccatctcggggctccaggctgaggacgaggctgcttattactgcagctcatatacaaggagcaccactctcgtggtatttggtggaggaccaagctgaccgtctaggtcagcccaaggctgccccctcggt

SEQ ID NO: 782711 - DNA, 498 bp, Homo sapiens
  misc_feature: HIJSMM301ARMXI.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaacttatttggattggtacctgcagaagccagggcagtctccacagctcctgatctatttgggttctaatcgggcctccggggtccctgacaggttcagtggcagtggatcaggcacagtattttacactagaaaatcagcagagtggaggctgaggatggttggggtttattactgcatgcaagctctacaaactccttactacttttggccgtaggggaccaagcgtggagatacaaacgaact

SEQ ID NO: 782712 - DNA, 491 bp, Homo sapiens
  misc_feature: HIJSMM301BE4YZ.47.70.G04.1.454.light.4.raw
  modified_base (351)..(351): a, c, t, g, unknown or other
  modified_base (477)..(477): a, c, t, g, unknown or other
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaacgccctaaacctcctgatctatgctgcatccagtttgcatagtggggtcccatctaggttcagtggcagtggatctgggacngatttcactctcacatcagcagtctgcaacctgaagtatttgcaacttactactgtcaacagagttacggtaccccgtactacttttggaccgagggaaccaactggacatacaaacaacgtgtgntgcaccactctgtt

SEQ ID NO: 782713 - DNA, 462 bp, Homo sapiens
  misc_feature: HIJSMM301AMGZ0.22.28.C06.1.454.light.4.raw
acatacgcgtcacgaccggtgctcgatttagagctcacgtattggggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctcgttcccaccctcctcacgcgtatgt

SEQ ID NO: 782714 - DNA, 493 bp, Homo sapiens
  misc_feature: HIJSMM301DMDVM.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaaacttactactgtcaaacagagttacagtaccccccctcactttcggcggagggaccaaggcggagatcagacgaactgtggctgcacccatcctgtctttc

SEQ ID NO: 782715 - DNA, 510 bp, Homo sapiens
  misc_feature: HIJSMM301ENBG9.53.30.C08.1.454.light.4.raw
cgcgtatacacacgaccggtgctcgatttagtctgacgtcaaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggcctcagggatccctgagcgattctctggctccaggtcagggacaacggtcacattggccatcagtggagtccaggcagaggacgagctgctattattgtcaatcaacagacacattggtacttaatgtcttcggaacgtgcgaaccaaggtacaccgtccgtgggttcgagcccaaggccaacccccgaactcgtccactcttccg

SEQ ID NO: 782716 - DNA, 498 bp, Homo sapiens; identical to SEQ ID NO: 578989
  misc_feature: HIJSMM301AJF9R.43.34.D01.1.454.light.4.raw

SEQ ID NO: 782717 - DNA, 447 bp, Homo sapiens
  misc_feature: HIJSMM301C1U1J.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctcgttcccacccctcctctacgtgagct

SEQ ID NO: 782718 - DNA, 510 bp, Homo sapiens
  misc_feature: HIJSMM301EJ0J1.17.33.C11.1.454.light.4.raw
  modified_base (459)..(459): a, c, t, g, unknown or other
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccgttggggcaaagctgccctgacactgtctggtgtgcagcctgaggacgaggctgactattactgcctactcttactttggtggtgctgtgctattcggcggagggaccaanctgaccgtcttaagtcagccaagcctgccccctcggtcactctcgtcccta

SEQ ID NO: 782719 - DNA, 536 bp, Homo sapiens
  misc_feature: HIJSMM301ENAVI.41.87.H10.1.454.light.4.raw
tctatactatcacgaccggtgctcgatttagcagtactgcgttgggtttggggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggcccaccctgaccatcaccgggggtcgagggccgggggatgaggccacctactattgtcacgtctgggagacgtggtgatgatcctgtggcgctattcggcggagggacgaagctgaccgtcctgggtcagcccaaggctcgccccctcggtcctactcctcgttccccaccctccctctaac

SEQ ID NO: 782720 - DNA, 500 bp, Homo sapiens
  misc_feature: HIJSMM301AL6QP.43.33.C11.1.454.light.4.raw
tgtgagtagtcacgaccggtgctcgatttagagtgagctcgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 782721 - DNA, 512 bp, Homo sapiens
  misc_feature: HIJSMM301BERKA.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaatagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgacctcctaggtcagcccaaggctgccccctcggtcacgtctgtt

SEQ ID NO: 782722 - DNA, 497 bp, Homo sapiens
  misc_feature: HIJSMM301EOVTI.51.6.A06.1.454.light.4.raw
  modified_base (408)..(408): a, c, t, g, unknown or other
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcaggggatccctgagcgattctctggctccacctcagggacaatggtcacattgaccatcagtggagtccaggcagaagacgaggctgactatttctgtcaatcttnagacatcagtggtacttatgtcttcggaactgggaccaaggtcaccgtcctaggtcagcccaaggaccaacccaactgtcactcttccg

SEQ ID NO: 782723 - DNA, 502 bp, Homo sapiens
  misc_feature: HIJSMM301DRZE4.40.67.G01.1.454.light.4.raw
tctagcgactcacgaccggtgctcgatttagagtatacatattggggtttggggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtgacatcaaacgactgtggctgcaccatctgtcttcatcttccgcat

SEQ ID NO: 782724 - DNA, 508 bp, Homo sapiens
  misc_feature: HIJSMM301BVFEG.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttcacttttcggcggagggaccaaggtggacctcaaacgaactgtggctgcaccatctgtcttcatccttcccgcc

SEQ ID NO: 782725 - DNA, 488 bp, Homo sapiens
  misc_feature: HIJSMM301DX06A.11.12.B01.1.454.light.4.raw
  modified_base (462)..(462): a, c, t, g, unknown or other
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtctaggtcngcccaggctcgccccctcggtcactc

SEQ ID NO: 782726 - DNA, 447 bp, Homo sapiens
  misc_feature: HIJSMM301DSDYU.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgtcccgccctcctccatactcgta

SEQ ID NO: 782727 - DNA, 508 bp, Homo sapiens
  misc_feature: HIJSMM301E24BX.18.78.H01.1.454.light.4.raw
tacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcgaggggtttctaatcgcttctctggctccaagtctgggcaacacggccctccctgaccatctctgggctccaggctgaggacgaggctgattattactgcagctcatatacaagcagcagcactcaagtcttcggaactgggaccaaggtcaccgtcctaggtcagcccaacggccaacccactgt

SEQ ID NO: 782728 - DNA, 484 bp, Homo sapiens
  misc_feature: HIJSMM301B6TS7.41.78.H01.1.454.light.4.raw
tctatactatcacgaccggtgctcgatttagtgtgagtagtttgggtttgggggatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcgggtccgggacagatttcacactgaggatcagtcgggtggaggctgacgacgttgggacttattactgcgcgcaaagtctacaccttcctactcactttgggccctgggaccaaagtggacatcaaacgaa

SEQ ID NO: 782729 - DNA, 500 bp, Homo sapiens
  misc_feature: HIJSMM301ESXIK.10.79.H02.1.454.light.4.raw
catagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagtattttgctagtgtattattgtcagcaatatggtaggtcaccgtgggtacttttggccgaggggaccaagcgtggagatacaaacgaactgtggctgcaccatctgtctt

SEQ ID NO: 782730 - DNA, 485 bp, Homo sapiens
  misc_feature: HIJSMM301EV6VP.8.74.G08.1.454.light.4.raw
  modified_base (451)..(451): a, c, t, g, unknown or other
ctcgcgtgtccacgaccggtgctcgatttagtagctctatcagggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcacctgcactggatccagcggagacattgggagttatgatgttgtctcttggtatcagcatcacccaggcacagccaccaaattcataatttatcaggtcacgcagcggcccttaggggtttctgatcgcttctctggctccaagtctggcaacacggcctccctgacaatctctgggctccagcctgaggacgaggctgattattactgctgctcatatggtggttctaacactccctatgtcttcggngtgggaccaaggtcaccgtctgcgtcagcccaac

SEQ ID NO: 782731 - DNA, 514 bp, Homo sapiens
  misc_feature: HIJSMM301EUYVF.13.81.H04.1.454.light.4.raw
tcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagctaccctttatgttcttcgggactgtgaccaggtcaccgtcctaggtcagcccaaggccaaccccactgtcactctgttccca

SEQ ID NO: 782732 - DNA, 494 bp, Homo sapiens
  misc_feature: HIJSMM301DZDSZ.41.67.G01.1.454.light.4.raw
tctatactatcacgaccggtgctcgatttagagtatacatattgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattatactgcagctcatatacaagcagcagcactctcgtggtattcggcggaggaccaagctggaccgtcctaggtcagcccaa

SEQ ID NO: 782733 - DNA, 502 bp, Homo sapiens
  misc_feature: HIJSMM301B5WO7.40.67.G01.1.454.light.4.raw
  modified_base (472)..(472): a, c, t, g, unknown or other
tctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcgggcggagggaccaaggtggacatcaaacgacngtggctgcaccatctgtcttcatctccgcc

SEQ ID NO: 782734 - DNA, 524 bp, Homo sapiens
  misc_feature: HIJSMM301DJ2MV.9.38.D05.1.454.light.4.raw
tgatacgtctcacgaccggtgctcgatttagtatctgatagttgggtttgggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaacgcccccaaactcttgctttatgatgtcagttatcggccctcaggtagtttctgatcgcttctctggctccaagtctggcaccacggcctccctgaccatctctgggctccaggctggaggacgaggctgtattatttctgcagctacaaaagagtacgcctctcgtggtttcgggcgggggaccaaggtcgaccgtcctaagtcagccaagctcgccccctcggtccactctcgtcccaccctcc

SEQ ID NO: 782735 - DNA, 477 bp, Homo sapiens
  misc_feature: HIJSMM301EZOU1.5.12.B01.1.454.light.4.raw
atcagacacgcacgaccggtgctcgatttagtagtgtagattccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgtattttcggcggtagggaccaagctgaccgt

SEQ ID NO: 782736 - DNA, 509 bp, Homo sapiens
  misc_feature: HIJSMM301BIC6V.41.30.C08.1.454.light.4.raw
tctatactatcacgaccggtgctcgatttagtctgacgtcaaagggaaaggtggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaacccactgtccta

SEQ ID NO: 782737 - DNA, 303 bp, Homo sapiens
  misc_feature: HIJSMM301BJLE5.49.19.B08.1.454.light.4.raw
agtcgagagacacgaccggtgctcgatttagtgagtcagtaagggccccagactcctcattcatgacaatagcaagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggaccaagctgaccgtcctaggtcagcccaaggctggccctcggtcactctgttcccgccctcctctctctcgact

SEQ ID NO: 782738 - DNA, 494 bp, Homo sapiens; identical to SEQ ID NO: 602013
  misc_feature: HIJSMM301E37JJ.47.64.F09.1.454.light.4.raw

SEQ ID NO: 782739 - DNA, 478 bp, Homo sapiens
  misc_feature: HIJSMM301EEWIZ.40.59.F04.1.454.light.4.raw
tctagcgactcacgaccggtgctcgatttagtacacacacttagggattgggggggcctcaggaagcagcatcggaggtgcctcagccatggcatggatccctctcttcctcggcgtccttgcttactgcgacaggctccgtggcctcctatgacttgactcagccaccctcagtgtccgtgtcccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggttggtttcggcggagggaccaagctagacctcctaacgtcagccc

SEQ ID NO: 782740 - DNA, 507 bp, Homo sapiens
  misc_feature: HIJSMM301CV1R4.10.79.H02.1.454.light.4.raw
  modified_base (404)..(404): a, c, t, g, unknown or other
  modified_base (500)..(500): a, c, t, g, unknown or other
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagtattttgcagtntattattgtcagcaatatggtaggtcgacctgggtacttttggtccgaggggaccgaagacgtggtaggatcaaacgaactagtggctgcacactntcgtctt

SEQ ID NO: 782741 - DNA, 500 bp, Homo sapiens
  misc_feature: HIJSMM301DCWJC.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgccccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttatactgcatgcgagggtacactctggccgttctacttttggccgtagggaccgaaactaggactatcagacgaactagtggtgtcgtca

SEQ ID NO: 782742 - DNA, 503 bp, Homo sapiens
  misc_feature: HIJSMM301BNXPS.41.28.C06.1.454.light.4.raw
tctatactatcacgaccggtgctcgatttagagctcacgtattgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgaattattactgcagctcatatacaagcagcagcactctcgtggtattcggcgggagggaccaagctgacccgtcctaggtcagcccaaggctccg

SEQ ID NO: 782743 - DNA, 509 bp, Homo sapiens
  misc_feature: HIJSMM301EREJU.40.23.C01.1.454.light.4.raw
tctagcgactcacgaccggtgctcgatttagtacacgtgattagggattggggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcattataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggactggaggctgactattactgtcaggcgtgggacatcaggtcaggtggtagggttgggtttttcgggcgggtagggaccgaagccgtagacccgtcctaagtcacggcccgaacggtcccg

SEQ ID NO: 782744 - DNA, 508 bp, Homo sapiens
  misc_feature: HIJSMM301CLS47.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctcctgacagtctctcggctccaggcggaggacgaggctgattactactgcttctcatatgcagatactaagtcctgggtgttcggcggagggaccaaggctcgaccgtccgtaggtcagcccaaggcctcgccccctcggt

SEQ ID NO: 782745 - DNA, 480 bp, Homo sapiens
  misc_feature: HIJSMM301BNDMT.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctcgttcccgccctcctccgagtagtaca

SEQ ID NO: 782746 - DNA, 494 bp, Homo sapiens
  misc_feature: HIJSMM301B8HFS.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcacttcggcggagggaccaaggtggagatcaaacgactgtgctgcacactctgtcttcatt

SEQ ID NO: 782747 - DNA, 493 bp, Homo sapiens
  misc_feature: HIJSMM301EXO1M.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctggacttttggccaggggacaagctggagatcaaacgaactgtggctgcaccatctgtctt

SEQ ID NO: 782748 - DNA, 530 bp, Homo sapiens
  misc_feature: HIJSMM301AGFWY.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcggagggaccgaggctgaccgtccgtaggtcagcccaaggctcgccccctcggtccacgtctgttcccaccctccc

SEQ ID NO: 782749 - DNA, 458 bp, Homo sapiens
  misc_feature: HIJSMM301E3LED.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattagttactgtgcaatctgggatgacagtgtgaacggtccggttttcggcggagggaccaagctgaccgtcctaagtcagcccaaggctcgccccctcggtcactctcgttcccgccctcctccacgacgagta

SEQ ID NO: 782750 - DNA, 448 bp, Homo sapiens; identical to SEQ ID NO: 538166
  misc_feature: HIJSMM301C4M7O.18.9.A09.1.454.light.4.raw

SEQ ID NO: 782751 - DNA, 478 bp, Homo sapiens
  misc_feature: HIJSMM301AJTEQ.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggaccccaggctatggatgaggctgactattactgtcaggcgtgggacagcagcactgcccgctatgtcttcggaactgggaccaaggtcaccgtcctaagtcacgaccccg

SEQ ID NO: 782752 - DNA, 481 bp, Homo sapiens
  misc_feature: HIJSMM301AJ55U.16.86.H09.1.454.light.4.raw
tgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggaggaccaagctgaccgtcctaggtcacgcccaaggctcgccccctcggtcactctcttcccaccctccctcgagtagtaca

SEQ ID NO: 782753 - DNA, 496 bp, Homo sapiens
  misc_feature: HIJSMM301EQ6A0.13.6.A06.1.454.light.4.raw
  modified_base (488)..(488): a, c, t, g, unknown or other
tcacgtactacacgaccggtgctcgatttagatctactgacaggggagggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctcacaacctctgcggactttcggccctgggccaaagtggaggatcaacgaacctagtggctgcaccanctgtcttt

SEQ ID NO: 782754 - DNA, 500 bp, Homo sapiens
  misc_feature: HIJSMM301ERIFA.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggacagaagacgaggctgactattattgtcaagcagtagacagcgagtggtccttatcgggtgttcgggcgggggaccaagctgacgtcctaggtcagccaaggctgccccctcggtcactcttcg

SEQ ID NO: 782755 - DNA, 524 bp, Homo sapiens
  misc_feature: HIJSMM301EGK70.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaaatctggcaacacggcctttctgacaatctctcaactccaggctgaagacgaggctatttattactgctcctcatacgcaggtggcacattttttctttgggtttttggtcgggcgggacccgagactggacttgtccttcagttccagccccaaggtcctcgcccccgtcggt

SEQ ID NO: 782756 - DNA, 407 bp, Homo sapiens
  misc_feature: HIJSMM301E28YC.4.35.D02.1.454.light.4.raw
agcactgtagcacgaccggtgctcgatttagcacacgataggttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtccactctgttccccaccctcctcctacagtgct

SEQ ID NO: 782757 - DNA, 492 bp, Homo sapiens
  misc_feature: HIJSMM301AL64C.16.78.H01.1.454.light.4.raw
  modified_base (411)..(411): a, c, t, g, unknown or other
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcaggtgggtctgggacagagttcactctcaccatcagcagcctgcagtctgaagatttgcggtttatactgtcngcagtataataactggcctccacggtacacttttggccaggggaccaagctggagatcaaacaactgtggctgccacatct

SEQ ID NO: 782758 - DNA, 562 bp, Homo sapiens
  misc_feature: HIJSMM301D76WU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctggtacagatttcactctcaccatcagcagcctgcaggctgaagatggtggctagtttattactgtcaactagttttctcgggtcgttcggtccgaacgggacccgtaagggtaggtaaagtacgaaaaccggtaaactacggttagggtcgtcggtccgaacccaactaccttcggttcctttacctaacttccgtttacccccccgg

SEQ ID NO: 782759 - DNA, 485 bp, Homo sapiens
  misc_feature: HIJSMM301D7JW3.40.59.F04.1.454.light.4.raw
tctagcgactcacgaccggtgctcgatttagtacacacacttagggattggggctgggccccaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattacctgtcaggcgtgggacatcagcagtgaggtggttttcggcgggagggaccaagcgtgaccgtcctaagtcacggcccaac

SEQ ID NO: 782760 - DNA, 532 bp, Homo sapiens
  misc_feature: HIJSMM301ANYKZ.3.79.H02.1.454.light.4.raw
  modified_base (244)..(244): a, c, t, g, unknown or other
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttanatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctccgtggttagtttgggtgggagggaccgaaagccgtaggtacccgtccgtacggtcacggacccgaacggcctcgcccccctccgggt

SEQ ID NO: 782761 - DNA, 487 bp, Homo sapiens
  misc_feature: HIJSMM301DZVRI.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagaggtggaggctgagggatgttgggctctattattgcatgcaagctctacaagtcccgctcactttcggcggagggaccaaggtggagatcaaaacgaa

SEQ ID NO: 782762 - DNA, 523 bp, Homo sapiens
  misc_feature: HIJSMM301C249X.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcgggagggaccaggctgaccgtcctaggtcagcccaaggctgccccctcggtcactctgttcccgccct

SEQ ID NO: 782763 - DNA, 503 bp, Homo sapiens
  misc_feature: HIJSMM301B2XGN.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaacccaggacagccccctaaggtcctcatttactgggcatctacccgggagtccggggtccctgaccgattcagaggcagcgggtctggggacagatttcactctcaccatcaccaacctgcaggctgaagatgtggcagtttattactgtcagcaatactatagtcctcctctcacgttcggcggagggaccaagggtgagatcaaacgtactgtggctgcaccatctgtcttcactcttcccgccatctgactaa

SEQ ID NO: 782764 - DNA, 519 bp, Homo sapiens
  misc_feature: HIJSMM301BWFJ0.17.62.F07.1.454.light.4.raw
cgtagactagcacgaccggtgctcgatttagtagtcgcataaagggaaaggggtcccttccaagtatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcgggcggagggaccaagctgaccgtcctaggtcagccaaggcctgccccctggtccactctgttccccaccctcctacctacgtctacg

SEQ ID NO: 782765 - DNA, 488 bp, Homo sapiens
  misc_feature: HIJSMM301DN6PB.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagccagactggagcctgaagattttgcagtctattactgtcagcagtatggtcacgtcccaagaacttttggccaggggaccaagctggagatacaaacgaactgtggctgcaccat

SEQ ID NO: 782766 - DNA, 512 bp, Homo sapiens
  misc_feature: HIJSMM301AMQFW.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtccactctcgttcccta

SEQ ID NO: 782767 - DNA, 524 bp, Homo sapiens
  misc_feature: HIJSMM301AKQZT.48.17.B06.1.454.light.4.raw
  modified_base (507)..(507): a, c, t, g, unknown or other
agtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggcttcttatctgtattttcgggcggacgggaccaagctgaccgtcctacgtcacgcccaggctcgccccctcggtcnctctcgttcccaccctt

SEQ ID NO: 782768 - DNA, 495 bp, Homo sapiens
  misc_feature: HIJSMM301CUD7U.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctgaccggttctctggctccaagtctggctcttccgcctcctcgccatcactggctcgaggctgacgatgaggctgattactactgtctgtcctatgacgacgacctacacgactccggttttcggcggaggactaagctgaccgtctagtcacgccaac

SEQ ID NO: 782769 - DNA, 483 bp, Homo sapiens
  misc_feature: HIJSMM301C6K1V.48.85.H08.1.454.light.4.raw
agtatacatacacgaccggtgctcgatttagtatcactcagtcgcgggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatcagtcaggaaacacagcctcctgaccattactggactccaacctgaggacgaggctgactattatgctcagcatgggacaccagcctcaactgccggcggtattcggcgcagggaccaagctagaccgtcctaggtcacc

SEQ ID NO: 782770 - DNA, 507 bp, Homo sapiens
  misc_feature: HIJSMM301DB2GH.18.78.H01.1.454.light.4.raw
tacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggcctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaacccactgtcta

SEQ ID NO: 782771 - DNA, 505 bp, Homo sapiens
  misc_feature: HIJSMM301AHP4E.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttctctggatccaaggatgattccgccaacgcagggatattactcatctctgggctccagtctgacgatgagctgactattactgtttgacttggcacaacaacgcctggatcttcggacctgggaccaccggtctacccgtcctaggtcagcccaagctcgccccctcggtcactctcgtt

SEQ ID NO: 782772 - DNA, 509 bp, Homo sapiens
  misc_feature: HIJSMM301EIDKT.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctcttggctccaagtctggcaacacggcctccctgacaatctctgggctccaggctgaggacgaggctgattactactgctgctcatatgcaggtcgtatctcttatgtcttcggaactgggaaccaaggtcaccgtcctagtcagcccaaggcccaaccccactgtcta

SEQ ID NO: 782773 - DNA, 447 bp, Homo sapiens; identical to SEQ ID NO: 535201
  misc_feature: HIJSMM301D673N.18.9.A09.1.454.light.4.raw

SEQ ID NO: 782774 - DNA, 477 bp, Homo sapiens
  misc_feature: HIJSMM301E2EFS.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccaccctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgtcaacttattactgtctacagatcacaatatactggtacgtgtccgacggaccgaacgacggtaagtagaacgaacgta

SEQ ID NO: 782775 - DNA, 512 bp, Homo sapiens
  misc_feature: HIJSMM301AHU5X.10.29.C07.1.454.light.4.raw
catagtagtgcacgaccggtgctcgatttagagtgctacgaaggggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatataacaaccagcagcacttctgtattcggcggagggaccaagctcgaccgtcctaggtcagcccgaaggctcgccccctcggtcca

SEQ ID NO: 782776 - DNA, 504 bp, Homo sapiens
  misc_feature: HIJSMM301AOZ6J.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgatttattattgcagctcatatgcaggcagttacaatgtgatattcggcggagggaccaactgaccgtcctaggtcagcccaaggctcgccccctc

SEQ ID NO: 782777 - DNA, 502 bp, Homo sapiens
  misc_feature: HIJSMM301BXLRU.41.34.D01.1.454.light.4.raw
tctatactatcacgaccggtgctcgatttagatcgtctgtgttggggtttgggggctttgcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggcctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgacgtcctaggtcagccaaggctcgccctcggtcactctcgttcccgccctccctcatagtataacg

SEQ ID NO: 782778 - DNA, 520 bp, Homo sapiens
  misc_feature: HIJSMM301D8EOJ.43.23.C01.1.454.light.4.raw
  modified_base (433)..(433): a, c, t, g, unknown or other
  modified_base (486)..(486): a, c, t, g, unknown or other
  modified_base (518)..(518): a, c, t, g, unknown or other
tgtgagtagtcacgaccggtgctcgatttagtacacgtgattagggattggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctggaggacgaggcgtgactattactgcctgctcatatatggtggcgngtgggtgttcgggcggagggaccaagctgaccgtcctgggtcagcccaaggcncgccccctcggtcactctgttcccaccctccnca

SEQ ID NO: 782779 - DNA, 511 bp, Homo sapiens
  misc_feature: HIJSMM301BFF9D.8.10.A10.1.454.light.4.raw
ctcgcgtgtccacgaccggtgctcgatttagcgtcgatctcaggggggagaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctttggcgcctttacagggccagtggaatcccagccaggttcagcggcagtgggtctgggacttcgttcactctcaccatcaataacctgcaatctgacgactttgctagtttatttctgtcagcagtctgaagactggccgttcactttcggcggagggaccgaaggtcggacctcaaacgaactgtggctgcaccatctgtcttcatcttcccgccatctgagacacgcg

SEQ ID NO: 782780 - DNA, 497 bp, Homo sapiens
  misc_feature: HIJSMM301AHP2T.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgctagtttattactgtcagcagtatggtacttcacaaaccttcggccgaggggacacgactggagattaaggcgaactgtggctgcaccatctgtctt

SEQ ID NO: 782781 - DNA, 507 bp, Homo sapiens
  misc_feature: HIJSMM301CIH3W.43.59.F04.1.454.light.4.raw
tgtgagtagtcacgaccggtgctcgatttagtacacacacttagggattgggggggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggcctcgccccctcggt

SEQ ID NO: 782782 - DNA, 513 bp, Homo sapiens
  misc_feature: HIJSMM301CD38W.17.33.C11.1.454.light.4.raw
  modified_base (438)..(438): a, c, t, g, unknown or other
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcggaccctgcccgattctcaggctccctccttggggcaaagctgccctgacactgtctggtgtgcagcctgaggacgaggctgactattactgcctactctactttggtggtgctgtgntattcggcggagggaccaagctgaccgtcttaagtcagccaaggctcgccccctcggtctactctcgttccccta

SEQ ID NO: 782783 - DNA, 495 bp, Homo sapiens
  misc_feature: HIJSMM301AVFD5.13.11.A11.1.454.light.4.raw
tcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccagggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtcacttttggccaggggaccaagctggagatcaagcgaactggtggctgcacctatctgtcttcta

SEQ ID NO: 782784 - DNA, 486 bp, Homo sapiens
  misc_feature: HIJSMM301EC0TR.40.57.F02.1.454.light.4.raw
tctagcgactcacgaccggtgctcgatttagctcgatatagttgggtttgggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctactttattttgctgctcttatgcaggcagtttcgctctcgagtgttcggcggagggccgagctcgaccgtcctacgtca

SEQ ID NO: 782785 - DNA, 510 bp, Homo sapiens
  misc_feature: HIJSMM301APIZB.8.42.D09.1.454.light.4.raw
ctcgcgtgtccacgaccggtgctcgatttagacacatacgcagggaaaggggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacgagggtattcgggcggagggaccaaggttgaccgtctaggtcaggcccaaggcctcgccccctcggtcactctcgtt

SEQ ID NO: 782786 - DNA, 521 bp, Homo sapiens
  misc_feature: HIJSMM301BQLI0.7.34.D01.1.454.light.4.raw
cgtgtctctacacgaccggtgctcgatttagatcgtctgtgttggggttttgggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacaggcattagtttgggtggtttcgggcggaggggaccaagctgaccgtcctgcgtcagcccaaggctcgcccctcggtcactt

SEQ ID NO: 782787 - DNA, 511 bp, Homo sapiens
  misc_feature: HIJSMM301DV83W.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaaactcatgattttatgagggcactaagcgggcccttcaggggtttcttatcgcttctctggctccgagtctggcaacacgcctccctgacaatctctgggctccaggctgaggacgaggcggattattactgttgctcattatgcgggtagtagcactttcgatgtcctattcggcggagggaccaagctgaccgtcctgggtcagcccaaggctgccccctcggtccactcctgttcccaccctcctctccgtcgtat

SEQ ID NO: 782788 - DNA, 514 bp, Homo sapiens
  misc_feature: HIJSMM301A5UAV.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaagagccaccctctcctgcagggccagtcagagtgttggtacgtccttactctggtaccaacaaaaacctggccaggctcccaggctcctcatctatgatgcatccaccagggccactggcatccccgccagattcagtggcagtgggtctgggacagacttcactctcaccatcagcagcctggaccctgaagattttgcagttttattactgtcagcagcggaccaattggccccctctccctcactttcggcgggggaccaagggtggaggctcaaacgaactgtggctgcaccatctgttcttcatcttcccg

SEQ ID NO: 782789 - DNA, 509 bp, Homo sapiens
  misc_feature: HIJSMM301EUYCM.48.59.F04.1.454.light.4.raw
agtatacatacacgaccggtgctcgatttagtacacacacttagggattggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacagacttcactctcaccgtcagcagactggaccctgaagattttgcagttgtattactgtcagcagtatggtagctcaccgatccaccttcggccgaagggactacggactggagactttaaccgaacttgtggctggcaccgatcgtgtctt

SEQ ID NO: 782790 - DNA, 519 bp, Homo sapiens
  misc_feature: HIJSMM301A4HK6.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgcttattcggcggagggaccaaggctcgaccgttcttaaagtcacgcccaaggctcgccccctcggtcactctcgttccccta

SEQ ID NO: 782791 - DNA, 511 bp, Homo sapiens
  misc_feature: HIJSMM301CGLN1.49.23.C01.1.454.light.4.raw
  modified_base (502)..(502): a, c, t, g, unknown or other
agtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggcttccagtttagggacagtggccaccctgacagtcagtggggcccaggtggaggatgagggtgattactactgttactcaacagacattactactactctatagggtgttcggcggagggacaagctgaccgtcctggtcagcccaaggctgcccctcggtccactctnttcccgcct

SEQ ID NO: 782792 - DNA, 497 bp, Homo sapiens
  misc_feature: HIJSMM301DP631.41.35.D02.1.454.light.4.raw
  modified_base (443)..(443): a, c, t, g, unknown or other
  modified_base (480)..(480): a, c, t, g, unknown or other
tctatactatcacgaccggtgctcgatttagcacacgatagttgggtttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccagtctggcaatacggcctccctgacagtctctcggctccaggcggaggacgaggctgattactactgcttctcatatgcagatactaagtccngggtgttcggcggagggccaagctgacctctaggtcngcccaggctgcccctgt

SEQ ID NO: 782793 - DNA, 517 bp, Homo sapiens
  misc_feature: HIJSMM301AMFTU.52.36.D03.1.454.light.4.raw
cgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtcgtggggatggaggacacagtttggtggttcgggacgggagggaccgaagcgtcgaccgtcctacgtccagcccgaaggctcgcccccgtcggtccacttccg

SEQ ID NO: 782794 - DNA, 488 bp, Homo sapiens
  misc_feature: HIJSMM301EEL7N.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttcgtgggaacacagccactctgaccatcaggccgggacccaggctatggatgaggctgactattactgtcagggcgtgggacatcagcagtgaggttggttttcgggcggagggaccaagctcggaccgtcctaagtcagaccccg

SEQ ID NO: 782795 - DNA, 518 bp, Homo sapiens
  misc_feature: HIJSMM301CLZ88.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccaggggtggtgttcggcgggagggaccaagctgggccgtcctaggtcagcccaaggctgccccctcggtcactctgttccccaccctcctcgagtagtaca

SEQ ID NO: 782796 - DNA, 509 bp, Homo sapiens
  misc_feature: HIJSMM301A30T6.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctggaacagatttcactctcaccatcagcagcctgcaggctgaagatgtggctagtttattactgtcaactagttttctcgggcgttcgccgaaggaccgaacggtaggaatacaaacgaacgtagtggctgcaccatctgtcttcactcttccccg

SEQ ID NO: 782797 - DNA, 510 bp, Homo sapiens
  misc_feature: HIJSMM301EANO8.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcatggacccctgcccgattctcaggctccctccttgggggcaaagctgccctgacactgtctggtgtgcagcctgaggacgaggctgactattactgcctactcttacttggtggtgctgtgctattcggcggagggaccaagctgaccgtcttaagtcagcccaaggctgcccctcggtcactctgttcccaccct

SEQ ID NO: 782798 - DNA, 495 bp, Homo sapiens
  misc_feature: HIJSMM301AG21C.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagccctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgactgggttttattctactttcggcctcgggaccaaagtggtattcagacgaactgtggctgcacatctagtcttcta

SEQ ID NO: 782799 - DNA, 523 bp, Homo sapiens
  misc_feature: HIJSMM301A2V7E.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgagggctgattattattgtagttcatatacaaccagtgacacttgggtgttcggcggagggaccaggctgaccgtcctaggtcagcccaaggctgccccctcggtcactctgttcccaccctt

SEQ ID NO: 782800 - DNA, 526 bp, Homo sapiens
  misc_feature: HIJSMM301BG3GJ.17.75.G09.1.454.light.4.raw
cgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcgggggcaagctgccctgaccctaacgggggcgcagcctgaggacgaggccgactattattgcctactatcatttgatggtggtcgtctgcccatttcggcggcgggaccagggtggccgtcctgggtcagcccaaggctgcccctcggtcactctcgttcccgccctccctcctacgtctacg

SEQ ID NO: 782801 - DNA, 509 bp, Homo sapiens
  misc_feature: HIJSMM301A2X15.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctcctgaccatctcttgggctcgagtctgaggacgaggctgattacttctgttgctcttgggcaactactgtcgtttgggtgttcggcggagggaccaagttgaccgtcctaggtcagccaaggctgccccctcggtcacttcg

SEQ ID NO: 782802 - DNA, 500 bp, Homo sapiens
  misc_feature: HIJSMM301BLWME.51.28.C06.1.454.light.4.raw
  modified_base (238)..(238): a, c, t, g, unknown or other
cgatcgtatacacgaccggtgctcgatttagagctcacgtattgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgacgaccaaggtcaccgtcctgggtcacgcccaacggccaaccccgactcgt

SEQ ID NO: 782803 - DNA, 476 bp, Homo sapiens
  misc_feature: HIJSMM301ASFST.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgctaacttactactgtcaacagagtccactaccccaatcactttcggccctggactgaagtgcatatgaagagaacgtgtggctgca

SEQ ID NO: 782804 - DNA, 498 bp, Homo sapiens
  misc_feature: HIJSMM301EM8RL.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgctagtttattactgtcagcagcgtaccaactggccgctcactttcggcggagggaccaaggtggagatcaacgaactgtggctgcaccatctgtcttcattcc

SEQ ID NO: 782805 - DNA, 487 bp, Homo sapiens
  misc_feature: HIJSMM301C8TO8.15.1.A01.1.454.light.4.raw
  modified_base (434)..(434): a, c, t, g, unknown or other
tctacgtagccacgaccggtgctcgatttagacgtctcatcagggccgtgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcngcccaaggctgccccctcggtcactctcgttcccgccctcctcgctacgtaga

SEQ ID NO: 782806 - DNA, 500 bp, Homo sapiens
  misc_feature: HIJSMM301B2KC0.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtgttagttcggcggagggaccaagctgaccgtccaaggtcagcccaaggctccc

SEQ ID NO: 782807 - DNA, 498 bp, Homo sapiens
  misc_feature: HIJSMM301EHTG2.18.59.F04.1.454.light.4.raw
  modified_base (446)..(446): a, c, t, g, unknown or other
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactntctatgtcttcggaactgggaccaaggtcaccgtcctaggtcagcccaagga

SEQ ID NO: 782808 - DNA, 510 bp, Homo sapiens
  misc_feature: HIJSMM301DN6SC.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggtagggactaaggctgaccgtcctaagtcagcccaaggctgccccctcggtcactctcgttcccgt

SEQ ID NO: 782809 - DNA, 523 bp, Homo sapiens
  misc_feature: HIJSMM301AUBBB.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagacccaaggcctgccccctcggtcactctcgttcccgccctccttacccg

SEQ ID NO: 782810 - DNA, 491 bp, Homo sapiens
  misc_feature: HIJSMM301BYJY5.11.11.A11.1.454.light.4.raw
  modified_base (475)..(475): a, c, t, g, unknown or other
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaaacgataaggactatttagcttggtatcagacaaaaaccaggacagcctcctaaactgctcatctcctgggcatctacccgggcacccggagtccctgaccgattcagtggcaggcgggtctgggacagacttcactctcaccatcagcaacctgcaggctgaagatgtggctagtttattactgtcagcagttattgtgaagctccgctcaacgtttcggcggtacgggaccgcgggtggagatcgaagacgaactgtggntgcaccatctgtcctt

SEQ ID NO: 782811 - DNA, 523 bp, Homo sapiens
  misc_feature: HIJSMM301BVXRK.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaacgcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctcgttcccaccctccta

SEQ ID NO: 782812 - DNA, 493 bp, Homo sapiens
  misc_feature: HIJSMM301EFH1M.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagtattttacactagaaaatcagcagaggtggaggctgaggagtgttgggcttcttattattgcatgcaagctctaacaacgtccgctcactttcggcggagggacgaaggtggagatacaaacgaac

SEQ ID NO: 782813 - DNA, 511 bp, Homo sapiens
  misc_feature: HIJSMM301AEJ9L.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatacaggtcgtatctcttatgtcttcggaactgggaccaggtcaccgtcctaggtcacgacccaacggacccaaccccactcgtcacct

SEQ ID NO: 782814 - DNA, 516 bp, Homo sapiens
  misc_feature: HIJSMM301ARJ76.41.35.D02.1.454.light.4.raw
  modified_base (431)..(431): a, c, t, g, unknown or other
  modified_base (436)..(436): a, c, t, g, unknown or other
tctatactatcacgaccggtgctcgatttagcacacgatagttgggtttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggccaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgnagtanaactaagttcctggggttggttcggcggacgggaccgaagctgacccgtcctaggtcagcccaaggctcgccccctcggt

SEQ ID NO: 782815 - DNA, 501 bp, Homo sapiens
  misc_feature: HIJSMM301CS7Z0.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccgaagggaccaaggtggaaatacaaacgaactgtggctgcacca

SEQ ID NO: 782816 - DNA, 488 bp, Homo sapiens
  misc_feature: HIJSMM301B0330.26.23.C01.1.454.light.4.raw
  modified_base (485)..(485): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtccatcaaggttcagtggcgccggatctgggacagaattcactctcaccatcagcgggctccagtctgaggactctgcaacttattactgccaacaatatgattatttattctccagtcgttcggccgaggggaccaaggtggagtcaagcgaactgtgctgcacatcngtt

SEQ ID NO: 782817 - DNA, 498 bp, Homo sapiens
  misc_feature: HIJSMM301AP7BA.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagtatttttgctagttttattactgtcagcagtatggtacttccacaaccttacggccagggacacgactggagaatagcgaactgtggctgcaccatctcgtctt

SEQ ID NO: 782818 - DNA, 496 bp, Homo sapiens
  misc_feature: HIJSMM301AJIEW.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctccccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagaacttcactctcaccatcagcagcctagagcctgaagattttgactactttattactgtcagcagcgtagcaactggcctctcactttcggcggagggaccgagggtggagatcgagacgaactgtgctgcaccatctgtt

SEQ ID NO: 782819 - DNA, 496 bp, Homo sapiens
  misc_feature: HIJSMM301A133G.7.59.F04.1.454.light.4.raw
  modified_base (455)..(455): a, c, t, g, unknown or other
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagccccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccgaggaccgaggngggaagacaaacgaactataggctcgtcaccatctgtcttc

SEQ ID NO: 782820 - DNA, 506 bp, Homo sapiens
  misc_feature: HIJSMM301CNNUJ.21.22.B11.1.454.light.4.raw
  modified_base (458)..(458): a, c, t, g, unknown or other
tcgtcgctcgcacgaccggtgctcgatttagacgacagctcaggggagcttcagctgtggtagagaaaacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggagcaacatgggatgacaatctgagcggttgggngttcggcggagggaccaaaactgaaccgtcctaaggtcagcccaaggt

SEQ ID NO: 782821 - DNA, 513 bp, Homo sapiens
  misc_feature: HIJSMM301C6HXL.18.45.E01.1.454.light.4.raw
tacgagtatgcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggcccctcagggatccctgagcgattctctggcgccagctcgaggaacagtagtcacgttgaccatcagtggagtccaggcagaagacgaggctgactattattgtcaagcagtagacagcagtggtccttagtcgggttgtcgggtcggggggaccaggactgaccgtcctaggtcagacccaaggcctcgccccctcggtcactcttccg

SEQ ID NO: 782822 - DNA, 485 bp, Homo sapiens
  misc_feature: HIJSMM301ED7ZA.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttggttctaatcggcctccggggtccctgacaggttcagtggcagtggatcaggcacagtattttacactgaaaatcagcagagtggaggctgaggatgttgggctctattatgcatgcaagctctacaagtcccgctctactttcggcggagggaccgaaggtggagatacaaacgaa

SEQ ID NO: 782823 - DNA, 504 bp, Homo sapiens
  misc_feature: HIJSMM301CR3KF.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggtccgagggaaccgaagaccgtggagaagtcaaacgaactagtggctcgcaccactacttcg

SEQ ID NO: 782824 - DNA, 519 bp, Homo sapiens
  misc_feature: HIJSMM301BCT91.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggcctcagggatccctgagcgattctctggctccaagtctgggaacacggccaccctgaccatcagcagggtcgaagccggggatgaggccgatattactgtcaggtgtggaatggtgattatgattatgtcttcggaactgggaccaaggtcaccgtcctaggtcagcccgaaggccaaccccactcgcactctgttccccgccctcctccgt

SEQ ID NO: 782825 - DNA, 489 bp, Homo sapiens
  misc_feature: HIJSMM301A8X1T.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgcttcatatgaaggttataacactatactattcgggcggagggaccaagctgaccgtcctgcgtcagcccaaggctcgccccctcggtcactctcgttcccgccctcctcgctacgtaga

SEQ ID NO: 782826 - DNA, 507 bp, Homo sapiens
  misc_feature: HIJSMM301BL493.43.59.F04.1.454.light.4.raw
tgtgagtagtcacgaccggtgctcgatttagtacacacacttagggattgggggggggtctcaggaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttagggagttatagccttgtctcctggtaccaagtgcacccaggcaaacgcccccaaactcatgatttatgagggcactaagcggccctcaggggtttctgatcgcttctctggctccaagtctggcaacacggcctccctgacaatctctgggctccaggctgaggacgaggctgattattattgctgcttcatatgctagggtagttacacttatgtcttcggaattgggacgacggtcaccggtcctaggtcagcccaaggccaacccct

SEQ ID NO: 782827 - DNA, 491 bp, Homo sapiens; identical to SEQ ID NO: 566346
  misc_feature: HIJSMM301D581E.26.78.H01.1.454.light.4.raw

SEQ ID NO: 782828 - DNA, 509 bp, Homo sapiens
  misc_feature: HIJSMM301EOLXR.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcaccagcactctctatgtcttcggaactgggaccaaggtcaccgtcctaggtcacgcccaacggcccaacccgactgt

SEQ ID NO: 782829 - DNA, 497 bp, Homo sapiens
  misc_feature: HIJSMM301C0MC4.52.27.C05.1.454.light.4.raw
  modified_base (481)..(481): a, c, t, g, unknown or other
cgcagtacgacacgaccggtgctcgatttagacgcgatcgaagggtttgggggtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaagtggggtcccgtcaaggttcagtggccgtggatctgggacagatttcactctcaccatcagcagtctccaacctgaagattttgcaatttactactgtacaacagagtgacaatacccctcagactttcggcccgtgggaccagagtaggatatactaaacgaactgtggctcgnaccatctgttcttcta

SEQ ID NO: 782830 - DNA, 512 bp, Homo sapiens
  misc_feature: HIJSMM301EILTK.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgtacttattactgccaggtcatatacaatcagcaacacttatgtcttgggactgggaccaagaactcaccgtcctaggtcacgcccaacggcccaaccccactcgtcta

SEQ ID NO: 782831 - DNA, 524 bp, Homo sapiens
  misc_feature: HIJSMM301C1D4K.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcacgccaaggcccaaccccactgtccactctcgttccccgccctcct

SEQ ID NO: 782832 - DNA, 511 bp, Homo sapiens
  misc_feature: HIJSMM301ALLVM.13.37.D04.1.454.light.4.raw
tcacgtactacacgaccggtgctcgatttagtagcatactgttgggtttggggggggggtcacaagaggcagcgctctcgggacgtctccaccatggcctgggctctgctgctcctcactctcctcactcaggacacagggtcctggggcccagtctgccctgactcagcctgcctccgtgtctgggtctcctggacagtcgatcaccatctcctgcactggaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacggaggctgcctattactgctgctcatatgcaggttcttctgtggtcttcgggcggacgggtccaaagtgaccgtcctaggtcaggcccaaggctgcccccgtcggtcta

SEQ ID NO: 782833 - DNA, 497 bp, Homo sapiens
  misc_feature: HIJSMM301A17HL.14.53.E09.1.454.light.4.raw
  modified_base (307)..(307): a, c, t, g, unknown or other
  modified_base (417)..(417): a, c, t, g, unknown or other
cgtctagtaccacgaccggtgctcgatttagagagagtgtgttgggtttgggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctnagggatccctgagcgattctctggctccagctcagggacaacactcaccttgaccatcagtgcagtccaggcagaagacgaggctgactattattgttcaatcagcagtnagcaactaattcttatcgggtgttcgggcggtagggccaagctgaccgtcctaggtcagcccaaggctcgccccctcggt

SEQ ID NO: 782834 - DNA, 518 bp, Homo sapiens
  misc_feature: HIJSMM301D7WWW.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtgaatggtgattatgattatgttcttcggaacgtgggaccaaggtcaccgtcctaggtcagcccaaggccaaccccactgtcactctgttccccacctcctccgt

SEQ ID NO: 782835 - DNA, 532 bp, Homo sapiens
  misc_feature: HIJSMM301B9A59.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagcctgaccgtcttaagtcagcccgtaaaggcgtcgtcccccgtccggttcaccgtcttgttccccctaccctccctt

SEQ ID NO: 782836 - DNA, 506 bp, Homo sapiens
  misc_feature: HIJSMM301CB20S.9.71.G05.1.454.light.4.raw
tgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctggggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgtcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggcctcgtccccccg

SEQ ID NO: 782837 - DNA, 502 bp, Homo sapiens
  misc_feature: HIJSMM301CCZ87.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtgggttttcgggcggggggaccgaaggtgaccgtcctaggtcagcccaaggtccg

SEQ ID NO: 782838 - DNA, 561 bp, Homo sapiens
  misc_feature: HIJSMM301AJVKN.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtccctcaaggttcagtggcagtggatctgggacagatttcactctcaccatccgcggtctgcaacctgaagatttcgcaacttactactgtcaacggactactacgtacgtccccccgaccctcctacccttaccggtcccgaaccgggaaccggaaccgaacgtacggtaggagttaaaacgtaaaccgtacggttggtcggtcgtccgacccaacctacttcgttcgtttccttactacctttccccccg

SEQ ID NO: 782839 - DNA, 496 bp, Homo sapiens
  misc_feature: HIJSMM301APRPM.51.45.E01.1.454.light.4.raw
cgatcgtatacacgaccggtgctcgatttagtgagtcagtaagggaaaggggactgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatggttggggtttattactgcgtgcaaagtctgacaactatcaccttcggccaagggacacgactggagagttaaacgaactgtggctgcta

SEQ ID NO: 782840 - DNA, 505 bp, Homo sapiens
  misc_feature: HIJSMM301AYBTF.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggactccctgagcgattctctggctccaggtcagggacaacggtcacattggccatcagtggagtccaggcagaggacgaggctgacttattattgtcaatacaacagacaccattggtacttatgtcttacggaactgcgacaaggtcaccgtcctgggtcacgcccaacggacccaccccactcgtcactcttccg

SEQ ID NO: 782841 - DNA, 530 bp, Homo sapiens
  misc_feature: HIJSMM301B3797.10.28.C06.1.454.light.4.raw
catagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaacgcccccaaactgatgatttatgatgtcagtaatcgaccctcaggggtttctgatcgcttctttgcctccaagtctggcaacacggcctccctgaccatctctgggctccagactgaggacgaggctgatttattactgcagctcacatacaagcggcagcggttgggtggtttcgggcggggggaccacactgtaccgtccgtaggtcacgacccgaaggcctcgccccctcggtccacttcctcgtt

SEQ ID NO: 782842 - DNA, 419 bp, Homo sapiens
  misc_feature: HIJSMM301BI1JU.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaattacttttgtcttcggaactgggaccaaggtcaccgtcctaggtcagcccaaggcccaaccccactgtcactctgttccccgccctcctcgagtagtaca

SEQ ID NO: 782843 - DNA, 491 bp, Homo sapiens
  misc_feature: HIJSMM301D826G.49.12.B01.1.454.light.4.raw
agtcgagagacacgaccggtgctcgatttagtagtgtagattccgcgggaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgttattttactttcaccatcatcaacctgcagcctgaggatattgcaacatattactgtacaacaatatgataatctaccactcactttcggcggagggacccaggtgaggatacaaacgaactgtaggctgcaccatcttcg

SEQ ID NO: 782844 - DNA, 495 bp, Homo sapiens; identical to SEQ ID NO: 585246
  misc_feature: HIJSMM301AOM9W.9.1.A01.1.454.light.4.raw

SEQ ID NO: 782845 - DNA, 512 bp, Homo sapiens
  misc_feature: HIJSMM301B965N.43.23.C01.1.454.light.4.raw
  modified_base (498)..(498): a, c, t, g, unknown or other
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggtttcaggctccctcctcgggggcaaagctgccctgacactgtcaggtgtgcagcctgaggacgaggctgactatactgctgctcatatatggtggcgcgtgggtgttcggcggagggaccgaagctgaccggtcctgggtcagcccaaggctgccccctcggtcnctctgttcccgcct

SEQ ID NO: 782846 - DNA, 494 bp, Homo sapiens
  misc_feature: HIJSMM301EQVCQ.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacacttatactattcggcggagggaccaagctgaccgtcctgcgtcacgcccgaaggctcgccccctcggtccactctcgttccccgccctcctcgcctacgtaga

SEQ ID NO: 782847 - DNA, 498 bp, Homo sapiens
  misc_feature: HIJSMM301DA87M.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtactcccagccaggttcagtggcagtgggtctgggacagagttcactctcaccatcagcagcctgcagtctagaagtattttgtcggtttattactgtcagcagtataataactggcctccacggtactactttggccgaggggaccaagctggagatcaaacgatgtggctgcacatctgt

SEQ ID NO: 782848 - DNA, 504 bp, Homo sapiens
  misc_feature: HIJSMM301DPGC3.9.71.G05.1.454.light.4.raw
tgatacgtctcacgaccggtgctcgatttagtgtcgtcgcaagagagagggggacgtctccaccatggcctgggctctgctgctcctcacccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttccttctttcaagtatattcggcgggagggaccaggctcgaccgtcctgagtcagcccgaaggctcgccccctcggtcactctcgtcccaccct

SEQ ID NO: 782849 - DNA, 492 bp, Homo sapiens
  misc_feature: HIJSMM301BU6Y9.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcgaggggtccctgaccgattctctggctccaagtctggcacctcacgcctccctggtcatcgctgggctccaggctgacgatgaggctgtattattattgccagtcctatcgactaaccaccctgcgttggttttggtctggtttcgggcggcgggacc

SEQ ID NO: 782850 - DNA, 488 bp, Homo sapiens
  misc_feature: HIJSMM301B8IUB.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgctaacttactactgtcaacagagttacaatacccctcggctcactttcggcggagggaccaaggtggagatcaaacgaactgtggcctgcaccta

SEQ ID NO: 782851 - DNA, 497 bp, Homo sapiens
  misc_feature: HIJSMM301BPQI7.9.1.A01.1.454.light.4.raw
  modified_base (376)..(376): a, c, t, g, unknown or other
  modified_base (477)..(477): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggancctgaggattttgcagtgtattactgtcagcagtatcataggtcaaacaccttcggccaagggacacgactggagattaaaggaactgtggtctgcaccanctgtcttcataccttccccg

SEQ ID NO: 782852 - DNA, 501 bp, Homo sapiens
  misc_feature: HIJSMM301BMYUL.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggcctcctcatctatgatgcatccaacagggccactggcatcccagccaggttcagtggcagtgggtctgggacagacttcactctcaccatcagcagcctagagcctgaagtattttgctagtttattactgtcagcagcgtagcaactggcctctcactttcggcggagggaccgaaggtggagatacaaacgaactgtggctcgcacactctgtctt

SEQ ID NO: 782853 - DNA, 501 bp, Homo sapiens
  misc_feature: HIJSMM301CLYRM.49.42.D09.1.454.light.4.raw
agtcgagagacacgaccggtgctcgatttagacacatacgcagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaacctggccaggctcccaggctcctcatctatgatgcatccaacagggccactggcatcccagccaggttcagtggcaggtgggtctgtgacagacttcactctcaccatcagcagcctagagcctgaagattctgctagtttattactgtcagcagcgtagcaactggcctctctacgtttcggcggacgggaccgaagggtggagatacaaaacgtaactggtggcgtgcaccatctgtt

SEQ ID NO: 782854 - DNA, 472 bp, Homo sapiens
  misc_feature: HIJSMM301D0F5F.17.67.G01.1.454.light.4.raw
cgtagactagcacgaccggtgctcgatttagagtatacatattggggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagccccctaactcctgatctatgctgcatccagtttgcagagtggggtcccatcaaggttcagtggcagtggatctgggacagatttcactctcaccatcagcagtctgcaacctgaagattttgctaacttatactgtcaacagagtctcagtaccccccggagttcggcgcggaccgaggtcggaatacgaacgaa

SEQ ID NO: 782855 - DNA, 513 bp, Homo sapiens
  misc_feature: HIJSMM301ARCZH.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcaggcggcaggtgggtcaggcgctgatttcacactgagaatcagcagggtggaggctgaagatggtcggggtttattactgcatgcagggtacaggtgtggcctttcgctcgctagttcgggcgggtagggaccgaaggtggagatacgaaacgaactggtggctgcc

SEQ ID NO: 782856 - DNA, 486 bp, Homo sapiens
  misc_feature: HIJSMM301D2GSJ.26.78.H01.1.454.light.4.raw
  modified_base (403)..(403): a, c, t, g, unknown or other
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagnttttagctactttattactgtcagcagcgtagcaactggcctctctacttcggcggagggaccgagggtggagatcagacgaa

SEQ ID NO: 782857 - DNA, 526 bp, Homo sapiens
  misc_feature: HIJSMM301D15MI.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgatttattattgtagttcataatacaaccagtgacacttgggtgttcggcggagggaccaggctgaccgtcctaggtcagcccaaggcctgccccctcggtcactctcgttcccaccct

SEQ ID NO: 782858 - DNA, 546 bp, Homo sapiens
  misc_feature: HIJSMM301C3BX2.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcgacgacggaacggacgacgtacgtaggagtaaacgttaaaccgtaacgtggtcgtcgtcgaccacctactacgttcgttccttacgtacttcccgttccccgacctacttacg

SEQ ID NO: 782859 - DNA, 496 bp, Homo sapiens
  misc_feature: HIJSMM301APOJL.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttcgcagtgtattactgtcagcagtatcataggtcaaacaccttcggccaagggacacgactggagattaaaggaactgtgctgcaccatctgtacttcattcttccccg

SEQ ID NO: 782860 - DNA, 495 bp, Homo sapiens
  misc_feature: HIJSMM301EINDL.51.35.D02.1.454.light.4.raw
  modified_base (473)..(473): a, c, t, g, unknown or other
cgatcgtatacacgaccggtgctcgatttagcacacgatagttggggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctggagcgattctctggctccaggtcagggacaacggtcacattggccatcagtggagtccaggcagaggacgaggctgactattatgtcaatcaacagacaccattggtacttatgtcttcggactgcgaccaaggtccacgtcctggtcngacccaaggcccaacccactgt

SEQ ID NO: 782861 - DNA, 488 bp, Homo sapiens; identical to SEQ ID NO: 572737
  misc_feature: HIJSMM301DJNH9.5.40.D07.1.454.light.4.raw

SEQ ID NO: 782862 - DNA, 507 bp, Homo sapiens
  misc_feature: HIJSMM301A2JWE.48.73.G07.1.454.light.4.raw
agtatacatacacgaccggtgctcgatttagctctacgctcagggggaagagctgctcagttaggacccagagggaaccatggaaacccccagcgcagcttctcttcctcctgctactctggctcccagatgcccccggagaaattgtgttgacgcagtctccagacaccctgtctttgtctaccaggggaaagagccaccttctcctgcaggtccagtcagagtcttaccaacgactacttagcctggtaccatcagaaacctggccaggctcccaggctcctcatctacggtacatccagcagggcccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccactctgtcttctactcttccccgt

SEQ ID NO: 782863 - DNA, 474 bp, Homo sapiens
  misc_feature: HIJSMM301EACKU.43.76.G10.1.454.light.4.raw
tgtgagtagtcacgaccggtgctcgatttagtcactcatacaggggactgcgggggtaagaggttgtgtccaccatggcctggactcctctcctcctcctgttcctctctcactgcacaggttccctctcgcaggctgtgctgactcagccgtcttccctctctgcatctcctggagcatcagccagtctcacctgcaccttgcgcagtggcatcaatgttgctacccacacaatatactggtaccagcagaagtcagggagtcctccccagtttctcctgaggtacaaatcagactcagataagcagcagggctctggaatccccagccgcttctctggatccaaggatgcttcggccaatgcaggaattttgctcatctctgggctccagtctgaggatgaggctgactattactgtacgatttggcacaacgacgctgtggtttcggcggagggaccaagctgaccgtcct

SEQ ID NO: 782864 - DNA, 530 bp, Homo sapiens
  misc_feature: HIJSMM301C8U50.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcaagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgtcggctacgggaccgaacggagggtaagtaacgaaaccgaacgtaacgtaggtcggttcgcgaccactactcgtcttcctattctttccccg

SEQ ID NO: 782865 - DNA, 454 bp, Homo sapiens; identical to SEQ ID NO: 534964
  misc_feature: HIJSMM301AWOGT.19.86.H09.1.454.light.4.raw

SEQ ID NO: 782866 - DNA, 485 bp, Homo sapiens; identical to SEQ ID NO: 553490
  misc_feature: HIJSMM301D8HXE.46.35.D02.1.454.light.4.raw

SEQ ID NO: 782867 - DNA, 484 bp, Homo sapiens
  misc_feature: HIJSMM301AJC6O.49.82.H05.1.454.light.4.raw
agtcgagagacacgaccggtgctcgatttagtcgagctctctcgcgggcacgaccggtgctcgatttagtcgagctctctcgcgggcacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaacaggggtcccatcaaggttcagtggaagtggctctgggacagtattttactttcaccatccagcaggctgtcagcctgaaagatattagcaacatattacttacg

SEQ ID NO: 782868 - DNA, 477 bp, Homo sapiens
  misc_feature: HIJSMM301EE3SS.49.28.C06.1.454.light.4.raw
agtcgagagacacgaccggtgctcgatttagagctcacgtattgggtttggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccaggaaagccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttaggccagggaccaggctggatatcagacgaacgtgtggctcg

SEQ ID NO: 782869 - DNA, 511 bp, Homo sapiens
  misc_feature: HIJSMM301AEGIO.16.46.E02.1.454.light.4.raw
tgtactactccacgaccggtgctcgatttagactcatctacagggaaaggggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctggctccaggctgaggacgaggctgattattactgcagcttatatacaggcaacaattacttttgtctttcggaacttggggaccaaggtcaccgtcctaggtcacgcccaacggccaaccccactcgtc

SEQ ID NO: 782870 - DNA, 514 bp, Homo sapiens
  misc_feature: HIJSMM301DKPMF.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctgtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaagttaggcgccactctcgtggttttcggcggaggcaccgaagtgaccgtctcggtcagccaaggctcgccccctcggtcactccg

SEQ ID NO: 782871 - DNA, 511 bp, Homo sapiens
  misc_feature: HIJSMM301DGJNV.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctcctgacaatctctgggctccagactgaggacgagggtgattattactgctgctcatacggagggactagaactttgctattcggcggagggaccaagttgaccgtcctaagtcagcccaaggctgccccctggtcactctgtt

SEQ ID NO: 782872 - DNA, 496 bp, Homo sapiens
  misc_feature: HIJSMM301A490Y.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtagggttgggatcgcagcctgactgcttacgtcttcggagctgggaccaaggtcaccgtcctaggtcagcccaaggcccaaccccactgtcactctcgttcccccgccctcctctacgtgagct

SEQ ID NO: 782873 - DNA, 490 bp, Homo sapiens
  misc_feature: HIJSMM301C07R8.4.27.C05.1.454.light.4.raw
agcactgtagcacgaccggtgctcgatttagacgcgatcgaagggtttgggggatcaggactcctcagttcaccttctcacaatgaggctccctgctcagctcctggggctgctaatgctctgggtctctggatccagtggggatattgtgatgactcagtctccactctccctgcccgtcacccctggagagtcggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcaagcagagtggaggctgaggatgttggggttactactgcatgcaagctactacaacgccacctactacttttggccgaggggaccaggctggagatacaaacgaacta

SEQ ID NO: 782874 - DNA, 509 bp, Homo sapiens
  misc_feature: HIJSMM301CVXBH.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgacgcgattctctggctcctcctcagggacaacagtcacgttgatcatcagtggagtccgggcaggaggacgaggctgactattactgtcaatcaacagacagtgtggtacttatgtgcaggttcgggcggagggaccaagcgtagaccgtctaacggtcagcccgaagctcgccccctacggtcacgtt

SEQ ID NO: 782875 - DNA, 478 bp, Homo sapiens
  misc_feature: HIJSMM301EHGHF.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggaccccaggctatggatgaggctgactattactgtcaggcgtgggacagcagcactgcccgctatgtcttcggactgggaccaacggtcacccgtcctaagtcagaccccg

SEQ ID NO: 782876 - DNA, 516 bp, Homo sapiens
  misc_feature: HIJSMM301ALJA0.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaactaatttcgttatactccgccgacggtcggtccgggggaccgaccgtcggaaatacaaacgaactagtggtctgcaccactactcgtc

SEQ ID NO: 782877 - DNA, 512 bp, Homo sapiens
  misc_feature: HIJSMM301EGD6J.9.53.E09.1.454.light.4.raw
  modified_base (437)..(437): a, c, t, g, unknown or other
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagtttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggngacaactcccgtggtattcgggacggagggaccaaggtgacccgtcttaggtcagcccaaggcctcgtccccccg

SEQ ID NO: 782878 - DNA, 511 bp, Homo sapiens
  misc_feature: HIJSMM301ADYCZ.5.86.H09.1.454.light.4.raw
atcagacacgcacgaccggtgctcgatttagtgctatagacttgggtttgggggggggtctcaggaggcagcgctctcaggacgtcaccaccatggcctgggctctgctcctcctcaccctcctcactcagggcacagggtcctgggcccagtctggggggccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagcgtgaccgtcctaggtcagcccaaggctgccccctcggtcta

SEQ ID NO: 782879 - DNA, 491 bp, Homo sapiens
  misc_feature: HIJSMM301B7PLL.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaattctcaccatcaccactctgcaacctgaggattgtgcaatctactactgtacacagagttacacgttcccctcgctacttttcggccaggggacctaaagttagagatcaaacgaactgtggctgcacatctgt

SEQ ID NO: 782880 - DNA, 512 bp, Homo sapiens
  misc_feature: HIJSMM301AK4FZ.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacggtcctccactactgcctccctcaccatctctggactgaagactgaggacgaggctgactactactgtcagtcttaatgataacaccagggtggtgttcggcggagggaccaagctggccgtcctaggtcagcccaaggctgccccctggtcactctgttcccacctcctcgagtagtaca

SEQ ID NO: 782881 - DNA, 494 bp, Homo sapiens
  misc_feature: HIJSMM301ECILH.10.33.C11.1.454.light.4.raw
  modified_base (475)..(475): a, c, t, g, unknown or other
  modified_base (478)..(478): a, c, t, g, unknown or other
catagtagtgcacgaccggtgctcgatttagagtgagctcgttggggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggacgggggaccaaggtagagttcaacgaactgtgntgnaccatctgtcttcatt

SEQ ID NO: 782882 - DNA, 463 bp, Homo sapiens
  misc_feature: HIJSMM301E1E1T.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctagaagatattgcaacatattactgtcacagtatgatcgtctcctcaatttcggccctgggaccagagtggacatgaaacgaa

SEQ ID NO: 782883 - DNA, 499 bp, Homo sapiens
  misc_feature: HIJSMM301AG8N0.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgctagttttttactgtcagcagtatagtaactggcctccgtactacttttggccaggggaccaagctagaaatcaaacgaactgtggctgcaccatctgtcttcta

SEQ ID NO: 782884 - DNA, 507 bp, Homo sapiens
  misc_feature: HIJSMM301DW4BC.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgctagtttattactgtcaccagtatcataactggcctccgaaggggactttcggcaaggaccaaggtggaattacaaccgaactgtggctgcaccatctgtcttcactcttcccg

SEQ ID NO: 782885 - DNA, 510 bp, Homo sapiens
  misc_feature: HIJSMM301B50HC.43.33.C11.1.454.light.4.raw
tgtgagtagtcacgaccggtgctcgatttagagtgagctcgttgggtttgggcggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttttgccgggcgagtcggcccattgacgactgtttggcctggtatcgcgtgagaccagggcaacctcctcaacttctgatataccgttcatcgctgttgcacgttggggtcccactcggttcagtggcaacggctctgagacagatttttctctcgtcatcactggtctacagtctgacgacggcgcaatgtacttctgtcaacactatgccctcctcccccctacaactttcggtcagggggacccaagttcgaacatctaacg

SEQ ID NO: 782886 - DNA, 498 bp, Homo sapiens
  misc_feature: HIJSMM301E0Q9J.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccacgccaccctgttctttgtctccagggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgcc

SEQ ID NO: 782887 - DNA, 501 bp, Homo sapiens
  misc_feature: HIJSMM301AJ9L0.22.15.B04.1.454.light.4.raw
acatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcagggtccctgatcgcttctctggctccaagtctggcaacacggctccctgaccgtctctgggctccaggctgaggatgaggctgattattactgcagctcatatggaggcagcgacaattttggtgttcggcggagggaccaagctgaccgtcctagtcagcccaaggctgccccctcggtca

SEQ ID NO: 782888 - DNA, 503 bp, Homo sapiens
  misc_feature: HIJSMM301A81XD.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttccagtggcaggtgggtctgggacagacttcactctcaccatcagcagactggagccgtgaggtattttgcagtgtattactgtcagcagtatcataggtacaaacaccttcggccaagggacacgactaggagaattaaaggaactggtggctgcaccatctgtcttcattcttccccg

SEQ ID NO: 782889 - DNA, 498 bp, Homo sapiens
  misc_feature: HIJSMM301D4TAP.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctggcaccatctgtcttcatcttccccg

SEQ ID NO: 782890 - DNA, 504 bp, Homo sapiens
  misc_feature: HIJSMM301D3RN4.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctacttagaaagtgggtcccatcaaggttcagcggcactggatctgggacagaattcactctcaccatcaacagcctgcagcctgatgatttggctaacttactactcgaccaaccgtatagtacttagttcggtcaccgttcggccgaagggacacggactggagattaaacgaactgtggcgtgcaccatctgtcttcattccc

SEQ ID NO: 782891 - DNA, 447 bp, Homo sapiens; identical to SEQ ID NO: 535020
  misc_feature: HIJSMM301EQP4U.18.9.A09.1.454.light.4.raw

SEQ ID NO: 782892 - DNA, 492 bp, Homo sapiens
  misc_feature: HIJSMM301DLRCJ.16.67.G01.1.454.light.4.raw
tgtactactccacgaccggtgctcgatttagagtatacatattgggtttggggggtagctcaggaagcagagcctggagcatctccactatggcctgggctccactacttctcaccctcctcgctcactgcacaggttcttgggccaattttacgctgactcagccccactctgtgtcggagtctccggggaagacggtgaccatctcctgcacccgcagcagtggcagcattgccaggaactttgtgcagtggttccagcagcgcccgggcagtgcccccaccacgtgtgatctatgaagataatcaaaggccctctggggtccctgatcgcttctctggctccatcgacacctcctccaactcagcctccctcaccatctctggatgaagcctgaggacgaggctgactactactgtcagtcttttaatgacaccgttgtgatagttcggcggagggaccaagctcgaccgtcctaggtcagcccaaggc

SEQ ID NO: 782893 - DNA, 519 bp, Homo sapiens
  misc_feature: HIJSMM301AGL7X.43.59.F04.1.454.light.4.raw
tgtgagtagtcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtctaggtcagccaaggctgccccctcggtccactctgttccccg

SEQ ID NO: 782894 - DNA, 505 bp, Homo sapiens; identical to SEQ ID NO: 618603
  misc_feature: HIJSMM301ER869.11.57.F02.1.454.light.4.raw

SEQ ID NO: 782895 - DNA, 513 bp, Homo sapiens
  misc_feature: HIJSMM301EGPD7.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactccataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtctaggtcagccaaggctgccccctcggtcactctgttccccg

SEQ ID NO: 782896 - DNA, 500 bp, Homo sapiens
  misc_feature: HIJSMM301CFAOD.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctggggacagacttcactctcaccatcagcagcctagagcctgaagactttggactttattacttgtcagcagcgtgtagttctggcctccgctcactttcggcggagggaccgagggtggagatcaaacgaactgtggctgcaccatctgtcttcattccc

SEQ ID NO: 782897 - DNA, 488 bp, Homo sapiens
  misc_feature: HIJSMM301BQNCL.11.28.C06.1.454.light.4.raw
  modified_base (405)..(405): a, c, t, g, unknown or other
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagntgtcgggtttattactgcatgcagggtacagtgtggccttcgctcgcattcggcggagggaccaaggtggagatacaaacgaa

SEQ ID NO: 782898 - DNA, 512 bp, Homo sapiens
  misc_feature: HIJSMM301ETKXC.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatggcccccaaactccctcatccagaggaataatcagcggccctcaggggtccctgaccgattctctggctccaagtctggcacctcagcctccctcgaccatcagtgggctccggtccgaggatgaggctgactattactgtgcatcacgggacgcaacagtggatgacaatctgagcgggttgggtgttcgggcggagggacccaaactcgaccgtcctagtcgacgcccgaac

SEQ ID NO: 782899 - DNA, 499 bp, Homo sapiens
  misc_feature: HIJSMM301BYWES.13.11.A11.1.454.light.4.raw
tcacgtactacacgaccggtgctcgatttagctacgactgcagggggccgtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcctagctacgtcgccccgactagtgtaccgttcgggaacctggggacccaagggtccaaccggtcctaaggtcagaccccg

SEQ ID NO: 782900 - DNA, 503 bp, Homo sapiens
  misc_feature: HIJSMM301DFC59.7.31.C09.1.454.light.4.raw
  modified_base (432)..(432): a, c, t, g, unknown or other
cgtgtctctacacgaccggtgctcgatttagacgtctcatcaaggaaggaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaacgcccccaaactcatgatttatgaggtcactaagcggccctcaggggtccctgatcgcttctctggctccaagtctggcaacacggcctccctgaccgtctctgggctccaggctgaagatgaggctgattattactgctgctcatatncaggccgcaacagtgatctagttcggcggagggacaagctgaccgtctaggtcagccaaggctgccccctc

SEQ ID NO: 782901 - DNA, 499 bp, Homo sapiens; identical to SEQ ID NO: 621418
  misc_feature: HIJSMM301A0WFO.18.59.F04.1.454.light.4.raw

SEQ ID NO: 782902 - DNA, 509 bp, Homo sapiens
  misc_feature: HIJSMM301CK2ZB.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaaggccggggatggaggccgactattactgtcaggtgtgggatagtagtggtgatcatccatacgtcttcggaactgggaccaaggtctccgtcctacgtcagcccaaggcccaactccactgtcacttcc

SEQ ID NO: 782903 - DNA, 505 bp, Homo sapiens
  misc_feature: HIJSMM301EAEHI.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcgcaatggatctgggacagaattcactctcaccatcaacagcctgcagcctgatgatttggcaacttactactgccaaccgtatagtacttattcggtcaccttcggccaagggacacgactgggagaattaaacgaacgttgtagggctggcaccatctgtcttcattcccg

SEQ ID NO: 782904 - DNA, 487 bp, Homo sapiens
  misc_feature: HIJSMM301B9963.41.50.E06.1.454.light.4.raw
tctatactatcacgaccggtgctcgatttagatctactgacaacacacaaggggtgatcaggactcctcagttcaccttctcacaatgaggctccctgctcagctcctggggctgctaatgctctgggtctctggatccactggggctgttgtgatgacacagtctccactctccctgcccatcacccctggcgagccggcctccatctcctgtaggtctagtctgagcctcctgtctagtagtggagacaactatttggattggtacctgcagaagccagggcagtctccacaactcctgattttattgggttttcatcgggcctccggggtccctgacaggttcagtggcagtggatcaggcacagattttacactgagtatcagcacagtggaggctgaggattggttggggtttattattgtgtgcaaactctacactccacgtggacgttcggccacgggacgagggtggatatcaaacgaa

SEQ ID NO: 782905 - DNA, 494 bp, Homo sapiens
  misc_feature: HIJSMM301DKLEV.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaattactatagtcctcctctcacgttcggcggagggaccaaggtggagatcaaacgaactgtggctgcaccatctgtcttcattcttcccgcact

SEQ ID NO: 782906 - DNA, 496 bp, Homo sapiens
  misc_feature: HIJSMM301DF6JG.46.26.C04.1.454.light.4.raw
  modified_base (428)..(428): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacggctcatcatctatttgggtctaatcgggcctccggggtccctgacaggttcagtggcagtggatcaggcacagattttacactgaaaatcagcagagtggaggctgaggtatggttgggctctattattgcatgnaagctctacaacgtcccgctcactttcgggcggaggggaccgaagggtggagatacgaaaccgaactt

SEQ ID NO: 782907 - DNA, 481 bp, Homo sapiens
  misc_feature: HIJSMM301ANF8R.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcacgcctgcagccctgaagattttgcaacttactattgtcaacaggctgacagtcctcccgcctctactttcggcggacgggaccgaaggtggagatacaaacgaactac

SEQ ID NO: 782908 - DNA, 526 bp, Homo sapiens
  misc_feature: HIJSMM301C2P2D.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccagtctccgggctccagcctgaggacgaggctgattattattgttagttctatatacaaccagtgaacacttgggtgttcggcgggacgggacgaggctgaccgtcctaggtcagccaggctgccccctggtccactctcgttcccaccct

SEQ ID NO: 782909 - DNA, 519 bp, Homo sapiens
  misc_feature: HIJSMM301AQYX4.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccagggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgctagtttattactgtcaacatcgtaccgaggtggccgtccgggggccacgtttcggccctgggaccaaattagagatacaaacgaactagtcggctgcaccatctgtcttctactcttcccgcctatcg

SEQ ID NO: 782910 - DNA, 502 bp, Homo sapiens
  misc_feature: HIJSMM301CKBWB.3.33.C11.1.454.light.4.raw
  modified_base (473)..(473): a, c, t, g, unknown or other
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactggttttcgggcggtagggaccaagctcgaccgtcctaggtcagcccaaggctcgccccctcggtccnctctcgtcccaccctcctcgagtgcgtct

SEQ ID NO: 782911 - DNA, 491 bp, Homo sapiens
  misc_feature: HIJSMM301AIMNO.12.27.C05.1.454.light.4.raw
atacgacgtacacgaccggtgctcgatttagacgcgatcgaagggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacggccaacatcacctgctctggagataaattggggcataaatatgtctgctggtatcaacagaaggcaggccagtcccctgtggttatcatctatcaagataacaagcggccctcagggatccctgagcgattctctggctccaactctgggaacacagccactctgaccatcagcgggacccaggctatggatgaggctgactattactgtcaggcgagggacagcagtactgcggtagttcggcggagggaccaagctgccgtcctaggtcagcccaaggctcgccccctcggt

SEQ ID NO: 782912 - DNA, 515 bp, Homo sapiens
  misc_feature: HIJSMM301AVHZ4.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgacagctcatatgcaggcagcagcagtccccatgtgatcgttcggccggggggacaagctacgaccgtcctacggtcacgcccaaggctccgtcccccg

SEQ ID NO: 782913 - DNA, 499 bp, Homo sapiens
  misc_feature: HIJSMM301DLV1F.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacaggatttcactctcaccgtcagcagtctgcaacctagaagattttgcaacttactactgtcaacagagttacacgtacccccctctacctttcggcgggaacgggaccgaagggcggagatcacgagaactgtggctgcaccatcttgtcttct

SEQ ID NO: 782914 - DNA, 490 bp, Homo sapiens
  misc_feature: HIJSMM301AQFAV.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtgaggctgaggatgtcgggttactactgcatgcagggtacacgtctcggccgttctacttttggccgtaggggaccaaacgtggagtatcagacgaactgtggc

SEQ ID NO: 782915 - DNA, 521 bp, Homo sapiens
  misc_feature: HIJSMM301EB87C.22.30.C08.1.454.light.4.raw
  modified_base (433)..(433): a, c, t, g, unknown or other
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacgaagggggtcgggatccctgatcgcttctcgggctccagctctggggccgagcgctacctcaccatctccagcctccagtctgaagatgaggctgactattactgtcagacatgggacgctggcgtntggctgttcggcggagggaccaagctgaccgtcctaggtcagcccaaggctcgccccctcggtcactctcgttcccgccctcctcacg

SEQ ID NO: 782916 - DNA, 523 bp, Homo sapiens
  misc_feature: HIJSMM301AXW3W.43.34.D01.1.454.light.4.raw
tgtgagtagtcacgaccggtgctcgatttagatcgtctgtgttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgtatttatgagggcactaagcggccctcaggggtttctgatcgcttctctggctccaagtctggcaacacggcctccctgacaatctctgggctccaggctgaggacgaggctgattattattgctgcttcattatggtcaggtaagttacactttaatgttcttcggaatttgggacgacggtccaccggtaccctagggttcacgcccaaacggcccaaaccccca

SEQ ID NO: 782917 - DNA, 493 bp, Homo sapiens
  misc_feature: HIJSMM301AE2XG.48.73.G07.1.454.light.4.raw
  modified_base (453)..(453): a, c, t, g, unknown or other
agtatacatacacgaccggtgctcgatttagctctacgctcagggcacgaccggtgctcgatttagtatctgatagttggggtttggggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcagganacaatactcgcacgcaagtactgttcggcggagggaaccg

SEQ ID NO: 782918 - DNA, 487 bp, Homo sapiens
  misc_feature: HIJSMM301BVMD2.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaacctggccaggctcccaggctcctcatctatgttgcatccatcagggccactggcatcccaggcagattcagtggcagtgggtctgggacagacttcactctcaccatcagcagactggagcctgagattttgcagtctattactgtcagcagtatggtcacgtcccagaacttttggccagggaccaagctggagatcaaacgaactgtggctgcaccatctgtt

SEQ ID NO: 782919 - DNA, 499 bp, Homo sapiens
  misc_feature: HIJSMM301CJUJ4.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttggcggagggaccaagctgaccgtcctaggtcacgcccaaggcctcgccccctcggtcactctcgttcccgcccttcct

SEQ ID NO: 782920 - DNA, 482 bp, Homo sapiens
  misc_feature: HIJSMM301D7JQU.11.73.G07.1.454.light.4.raw
  modified_base (465)..(465): a, c, t, g, unknown or other
cgagagataccacgaccggtgctcgatttagctctacgctcagggggcaggagtcagtcccaaccaggacacagcatggacatgagggtccctgctcagctcctggggctcctgctgctctgtctctcaggtgccagatatgacatccagttgacccagtctccatcctccctgtctgcatctataggagacagagtcaccatcacttgccaggcgagtcaggacattaagaactatttaaattggtatcggcagcggaccagggaaagccccctgagctcctgatctacgatgcgtccaatttggaaacagaggtcccaccgaggttcagtggaagtggatctgggacagtactttactctcaccatcagcagcctgcagcctgaagatattgcaacatattactgtcaacagtatgatcgtctcctctaatttccggcccttagggacccaaggagtaggaanagtagaaacgaactggt

SEQ ID NO: 782921 - DNA, 483 bp, Homo sapiens
  misc_feature: HIJSMM301C61VD.40.86.H09.1.454.light.4.raw
tctagcgactcacgaccggtgctcgatttagtgctatagacttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacatattctggtcaatctcattctttcggcggagggaccaaggtggagatcagacgaa

SEQ ID NO: 782922 - DNA, 528 bp, Homo sapiens
  misc_feature: HIJSMM301EQIPZ.17.1.A01.1.454.light.4.raw
cgtagactagcacgaccggtgctcgatttagacgtctcatcaaggaaggaggaacagaaagagaggagtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcgggcggagggaccaagctgaccgtcctaggtcagcccaaggctcgccccctcggtccactctcgttccccgccctcccttccg

SEQ ID NO: 782923 - DNA, 496 bp, Homo sapiens
  misc_feature: HIJSMM301A2LIY.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcaggcgggtctgggacagatttcactctcaccatcagcagcctgcaggctgaagatgtggcagtttattactgtcagcaatattatatactcctccgacggctctactttcggtcggacgggaaccgaacggtggaggatacaaacgaact

SEQ ID NO: 782924 - DNA, 490 bp, Homo sapiens
  misc_feature: HIJSMM301BODM6.7.75.G09.1.454.light.4.raw
  modified_base (460)..(460): a, c, t, g, unknown or other
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcgggcggtgggatctagggcagatttcactctcaccatcaatcacctgcaggctgaggattttgcaacttactactgtcagcaaggctaacaggctgcccccaaccttcggccaggggacacgaactgganagttaaaacaaactgtgtctgcaccaatct

SEQ ID NO: 782925 - DNA, 522 bp, Homo sapiens
  misc_feature: HIJSMM301A9VGX.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggcctccaggctgaggacgaggctgattatttctgcagctcatacacaaccggcaccactgtcgtggttttcggtggagggaccaagctgacctcctaggtcagcccaaggcctgcccccctggtccacttcc

SEQ ID NO: 782926 - DNA, 445 bp, Homo sapiens; identical to SEQ ID NO: 554977
  misc_feature: HIJSMM301C20TB.8.73.G07.1.454.light.4.raw

SEQ ID NO: 782927 - DNA, 502 bp, Homo sapiens
  misc_feature: HIJSMM301D9K4O.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcacccatcaatagcctggaagctgaagatgctgcaacttattactgtcatcagagtactactttacctcaagtgatcacccttcggccaagggacacgacgtggagattaaacgaactcgttggctgccaccatctagtt

SEQ ID NO: 782928 - DNA, 542 bp, Homo sapiens
  misc_feature: HIJSMM301BS2AV.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgctagtttattactgtcaacatcgtaccgagtcggccgtccgggggccctacgtttcggtcccgtcggggaccgaaacgtagggataagtacaaaccgaaactcggttggcgttcgacgaccacgtcttcggttctttcta

SEQ ID NO: 782929 - DNA, 512 bp, Homo sapiens; identical to SEQ ID NO: 710282
  misc_feature: HIJSMM301BP7H0.51.38.D05.1.454.light.4.raw

SEQ ID NO: 782930 - DNA, 493 bp, Homo sapiens
  misc_feature: HIJSMM301EVIS6.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcgggcggtggatctagggcagtatttcactctcaccatcaatcacctgcaggctgaggattttgactaacttactactgtcagcaggctaacaggctcgcccccaaccttccggccgaggggacacgactggagattaaacgaactgtggctgcaccatctgtt

SEQ ID NO: 782931 - DNA, 510 bp, Homo sapiens
  misc_feature: HIJSMM301CH0A4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgcacgggaaccaaggtaggaaagtacgaaacgaaactacgtggtactcggtcgaccaactctcgttcttcta

SEQ ID NO: 782932 - DNA, 511 bp, Homo sapiens
  misc_feature: HIJSMM301CRBJV.22.15.B04.1.454.light.4.raw
acatacgcgtcacgaccggtgctcgatttagacagtatatatccgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggtaggcagcgacaattttggtgttcggcggagggacctaagctgaccgtcctaaggtcagcccaaggctgccccctcggtcctac

SEQ ID NO: 782933 - DNA, 506 bp, Homo sapiens
  misc_feature: HIJSMM301A07PC.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcagcgaactgtggctgcaccatctgtcttcatcttccgcc

SEQ ID NO: 782934 - DNA, 501 bp, Homo sapiens
  misc_feature: HIJSMM301AGNBB.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcacgtccccatgtgatcttcgggcggggggaccgaagctcgaccgtcctaggtcagcccaagg

SEQ ID NO: 782935 - DNA, 509 bp, Homo sapiens
  misc_feature: HIJSMM301BQ5QY.22.15.B04.1.454.light.4.raw
acatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtcctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcaggcccaaggcctgccccctcggtcaccg

SEQ ID NO: 782936 - DNA, 503 bp, Homo sapiens
  misc_feature: HIJSMM301D01P1.16.72.G06.1.454.light.4.raw
  modified_base (489)..(489): a, c, t, g, unknown or other
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagtttcactctcaccatcagcagcctgcagtctgaagattttgtcagtttattactgtcagcagtataataactggcctccggtcactttcggcggagggaccgaaggtggagatctaaacgaactagtggcgtncgaccacgtcttcg

SEQ ID NO: 782937 - DNA, 497 bp, Homo sapiens
  misc_feature: HIJSMM301AR7QV.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccagggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtacaaacaccttcggccaagggacacgactggagattaaaggaactgtggctgcaccatctgtcttcatcttccccg

SEQ ID NO: 782938 - DNA, 487 bp, Homo sapiens
  misc_feature: HIJSMM301BPBMF.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactcgtggctgcaccat

SEQ ID NO: 782939 - DNA, 505 bp, Homo sapiens
  misc_feature: HIJSMM301CP98B.48.26.C04.1.454.light.4.raw
agtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtctaggtcagcccaaggctcgtccccccg

SEQ ID NO: 782940 - DNA, 529 bp, Homo sapiens
  misc_feature: HIJSMM301DSHQN.10.38.D05.1.454.light.4.raw
catagtagtgcacgaccggtgctcgatttagtatctgatagttggggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctgggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctggctccaggctgaggatggaggctgattactactgcagcgcatattcaggccccaacagggtgtttggcggcgggactaaggtgaccgtcgtgggtcagcccaaggctcgccccctcggtcactctcgttccccgcccttcccc

SEQ ID NO: 782941 - DNA, 516 bp, Homo sapiens
  misc_feature: HIJSMM301A1249.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacacgcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaattacttttgtcttcggactgggaccaaggtcaccgtcctaggtcagcccaacggccaaccccactcgtcactcttccg

SEQ ID NO: 782942 - DNA, 504 bp, Homo sapiens
  misc_feature: HIJSMM301AJ5E9.19.85.H08.1.454.light.4.raw
  modified_base (70)..(70): a, c, t, g, unknown or other
tactctcgtgcacgaccggtgctcgatttagtatcactcagtcgcggggtccaaacagagcttcagcaancatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctgccccctcggtcta

SEQ ID NO: 782943 - DNA, 511 bp, Homo sapiens
  misc_feature: HIJSMM301AZ6II.41.42.D09.1.454.light.4.raw
  modified_base (391)..(391): a, c, t, g, unknown or other
tctatactatcacgaccggtgctcgatttagacacatacgcagggaaaggggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagnttttgcgtatttattactgtcaccactataataattcggccctccgcgtggacgttcggtccgaaggaccgaggtacggaaagtacaaacgaactagtggctgcaccactcttgtcttct

SEQ ID NO: 782944 - DNA, 503 bp, Homo sapiens
  misc_feature: HIJSMM301ANNGE.3.70.G04.1.454.light.4.raw
  modified_base (471)..(471): a, c, t, g, unknown or other
agacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgctagtttattactgtcagcagggttacttctgcccactttcggccctgggaccaaagtggatatcaaacgaactgngactgacaccatctgtcttcatcttcccgcat

SEQ ID NO: 782945 - DNA, 511 bp, Homo sapiens
  misc_feature: HIJSMM301ARPVT.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctcctgacaatctctgggctccaggctgaggacgaggctgattactactgctgctcatatgcaggtcgtatctcttatgtcttcggaactgggaccaaggtccaccgtcctaggtcacgcccaaggcccaaaccccactcgtcta

SEQ ID NO: 782946 - DNA, 527 bp, Homo sapiens
  misc_feature: HIJSMM301DGXJQ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcgactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggcgggagggaccgaggctgaccgtcctaggtcaggcccaaggctcgccccctcggtcactctgttcccaccct

SEQ ID NO: 782947 - DNA, 521 bp, Homo sapiens
  misc_feature: HIJSMM301CTRL2.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtattattttgtcaggtgtgggagactaatttggtcatatgttgttcggcggagggaccaagctgaccgtcctcgggtcagcccaaggctcgccccctcggtcactctcgttcccgccctcctcc

SEQ ID NO: 782948 - DNA, 526 bp, Homo sapiens
  misc_feature: HIJSMM301ATGNZ.14.19.B08.1.454.light.4.raw
cgtctagtaccacgaccggtgctcgatttagtgagtcagtaagggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggcctccggtccgaggatgaggctgattattactgtgcagcatgggatgacagcctgagtggtccttgggttgttcgggcggagggaccaagctcgaccgtcctaagtcagcccaaggctcgcccccctcggtccactctcgttccccgccctcctccg

SEQ ID NO: 782949 - DNA, 494 bp, Homo sapiens
  misc_feature: HIJSMM301CA77Q.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaagggtggaggtcaaacgaactgtggactgcaccatctgtcttcatt

SEQ ID NO: 782950 - DNA, 523 bp, Homo sapiens
  misc_feature: HIJSMM301CXJLG.41.87.H10.1.454.light.4.raw
tctatactatcacgaccggtgctcgatttagcagtactgcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggttatttggcggagggaccaaggctgacctcctggtcagcccaagcctcgccccctcggtcactctcgttcccta

SEQ ID NO: 782951 - DNA, 452 bp, Homo sapiens
  misc_feature: HIJSMM301D7NFZ.18.9.A09.1.454.light.4.raw
tacgagtatgcacgaccggtgctcgatttagcgagacgcgcaggggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcgaggggtccctgaccgattctctggctccaagtctggcacctcagcctccctggccatcactgggctccaggctgaggatgaggctgactattactgccagtcctatgacatgaggctggagtggttcgtatgtcttcggatctgggaccaaggtcaccgtcctaagtcagcccaaggccaacccctctgtcactctcgttcccaccctcctccatacctcgta

SEQ ID NO: 782952 - DNA, 494 bp, Homo sapiens
  misc_feature: HIJSMM301A0DQW.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgaccaacaatatgattatttattctcccagcgttccggccgaggggaccgaaggtggaagtcaagcgaactgtggctgcaccatctgt

SEQ ID NO: 782953 - DNA, 516 bp, Homo sapiens
  misc_feature: HIJSMM301ETQ62.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagctggtaccagcagacccccgggccagacctccacgcacgctcatctacaacacagacactcgctcttctggggtccctgatcgcttctctggttccatccttgggaacaaagctgccctcaccatcggcgggggcccaggcagatgatgagtgtgattattactgtgtgctctatatgggcagtggtcggtttgggtggttcggcgggagggaccgaagctgaccgttcg

SEQ ID NO: 782954 - DNA, 543 bp, Homo sapiens
  misc_feature: HIJSMM301AGEG8.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattatttattgtagttcatatacaaccagtgacacttgggttggttcgggcgggagggaccgaggctcggaccgtcctacggtcacgccccaaggcctcgccccccgtcggtccacctctcgttccccctacccct

SEQ ID NO: 782955 - DNA, 515 bp, Homo sapiens
  misc_feature: HIJSMM301BJ01I.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctattcggcggagggaccaagctgaccgtcttaagtcagcccaaggctgccccctcggtccactctgttccccacctcctt

SEQ ID NO: 782956 - DNA, 482 bp, Homo sapiens
  misc_feature: HIJSMM301A0FVC.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtaccgtcctaggtca

SEQ ID NO: 782957 - DNA, 497 bp, Homo sapiens
  misc_feature: HIJSMM301D8ALR.27.78.H01.1.454.light.4.raw
  modified_base (401)..(401): a, c, t, g, unknown or other
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttnttactgtcatcagagtactacttacctcaagtgatcaccttcggaccaagggacacgactggagaattaaacgaactggtggctgcaccatctgtt

SEQ ID NO: 782958 - DNA, 490 bp, Homo sapiens
  misc_feature: HIJSMM301DN3UC.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgctactttattactgtcagcaatataatgactggttctcgatcaccttcggccaagggacacgactggagattaaacgaactagtggactgcaccatctgtt

SEQ ID NO: 782959 - DNA, 500 bp, Homo sapiens
  misc_feature: HIJSMM301EZXG1.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagtattttgcagtgtattattgtcagcaatatggtaggtcaccgtgggtacttttggccgtaggggaccaaggctggagatcaaacgaactgtggctgcaccatctgtctt

SEQ ID NO: 782960 - DNA, 510 bp, Homo sapiens
  misc_feature: HIJSMM301D3XM3.48.47.E03.1.454.light.4.raw
agtatacatacacgaccggtgctcgatttagactcgcgcacagagagaaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgttcagcagtatggaagttcacctcggacagttcggccaggggaccaaggtggaatcaaacgactaggtggctgcaccatctgtcttcatcttccccg

SEQ ID NO: 782961 - DNA, 512 bp, Homo sapiens
  misc_feature: HIJSMM301DEJQ5.4.39.D06.1.454.light.4.raw
  modified_base (449)..(449): a, c, t, g, unknown or other
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcgagggtccctgatcgcttctctgcctccaaggctggcaacacggcctccctgaccgtctctgggctccaggctgaggatggaggctgtattattattgcagctcatatgcaggcagttacaatgtnatagttcggacgggaggaccaaactcgaccgtcgtaggtcgagtccaaggtctcgccccctcc

SEQ ID NO: 782962 - DNA, 522 bp, Homo sapiens
  misc_feature: HIJSMM301CHWA1.26.26.C04.1.454.light.4.raw
agactatactcacgaccggtgctcgattttagtctagcgactttgggtttgggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagttattcactggccgtgggacgttcggccgaagggaccaaggtaggaaatacgaaacgaaacgtcgtggtccgtcgccgtaccacttcg

SEQ ID NO: 782963 - DNA, 498 bp, Homo sapiens
  misc_feature: HIJSMM301BBJ9O.16.68.G02.1.454.light.4.raw
  modified_base (492)..(492): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtgggtcccatcaaggttcagcggcagtggatctgggacagaattcactctcactatcaccagcctgcaacctgatgattttgctaacttattactgccaacagtatcatcatcattcgtaatttcggtggtagggaccgaaggtggaggtacaaacgaatggtaggctgcacatctgtcttnacttcc

SEQ ID NO: 782964 - DNA, 508 bp, Homo sapiens
  misc_feature: HIJSMM301AWS2G.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggttattggtggagggaccaagctgaccgtcctaggtcagcccaaggcctgccccctcggt

SEQ ID NO: 782965 - DNA, 492 bp, Homo sapiens; identical to SEQ ID NO: 732101
  misc_feature: HIJSMM301DU2JT.17.21.B10.1.454.light.4.raw

SEQ ID NO: 782966 - DNA, 528 bp, Homo sapiens
  misc_feature: HIJSMM301DTBUE.27.23.C01.1.454.light.4.raw
agcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctggaggacgagggctgtattattattgtagttcatatacaaccagtgacacttgggtgttcggcggagggaccaggctgaccgtcctaggtcagcccaaggctcgccccctcggtcactctcgttcccgccct

SEQ ID NO: 782967 - DNA, 522 bp, Homo sapiens
  misc_feature: HIJSMM301BFDMC.11.57.F02.1.454.light.4.raw
  modified_base (492)..(492): a, c, t, g, unknown or other
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagttggtcgtgggacagacttcattctcaccatccgcagcctagagcctgaagtattttgctagtttattactgtcaacagcgtagcagcaggcctccggccgacgttcggccgaacggacgaacggtaggaagtcgaagcgaacgtgtggtcgngcactactctgtcttcactcttcccgccac

SEQ ID NO: 782968 - DNA, 517 bp, Homo sapiens
  misc_feature: HIJSMM301BQWQO.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagccccaaactcatcatttttgaggtcactacgcaccctcaggggtccctgatcgcttctctggctccaagtctggcaacacggcctccctgaccgtctctgggctccaggctgaggatgaggctgattattactgcagctcatatgcaggcagacagcacgtccccatgtgtactcgttcgggcggggggaccgaacgcgtgaccgtcctaggtcacgcccaaggctcgtccccccg

SEQ ID NO: 782969 - DNA, 384 bp, Homo sapiens
  misc_feature: HIJSMM301B5XSU.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtaataga

SEQ ID NO: 782970 - DNA, 502 bp, Homo sapiens
  misc_feature: HIJSMM301B1MLB.13.5.A05.1.454.light.4.raw
  modified_base (434)..(434): a, c, t, g, unknown or other
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaagtcccggggtccctgaccgattcagtggcaggcgggtctgggacagatttcactctcaccatcagcagcctgcaggctgaagatgtggctagtttattactgtcagcaatattanagttacctcctccgaggctctactttcggcggagggaccgaagggtaggaggatacaaaacgaactgt

SEQ ID NO: 782971 - DNA, 507 bp, Homo sapiens
  misc_feature: HIJSMM301AHPAX.51.35.D02.1.454.light.4.raw
cgatcgtatacacgaccggtgctcgatttagcacacgatagttgggtttggggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagtattttgctaatttattactgtcagcagcgtagcaattggcctccctcgatcaccttcggaccaagggacacgactggagaataaacgaactgtggctgacaccatctgtcttcta

SEQ ID NO: 782972 - DNA, 492 bp, Homo sapiens
  misc_feature: HIJSMM301AUHGJ.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaggccctagactcctaatctatggtgcgtccggttgcacagtggcgtcccaggaagatcagcggcggtggatctagggcagatttcactctcaccatcaatcacctgcaggctgaggtattttgctaacttactactgtcagcaggctaacaggcctcgccccccaaccttccggccaggggacacgactgggaagtataaacgaactggtgctgccaccatctgtt

SEQ ID NO: 782973 - DNA, 499 bp, Homo sapiens
  misc_feature: HIJSMM301EFB8V.43.33.C11.1.454.light.4.raw
tgtgagtagtcacgaccggtgctcgatttagagtgagctcgttgggtttggggagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagtatttttctctcgtcatcactggtctacagtctgacgacggcgcaatgtacttctgtcaacactatcgccctcctcccccctactaactttcggtacgaggggaccaagttgaacatcaatcgaactgtggctgcaccatctgtt

SEQ ID NO: 782974 - DNA, 490 bp, Homo sapiens
  misc_feature: HIJSMM301D9ZHA.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgctaacttattaactgtctacaagattacaattaccctcgacgtcgccgagggaccaacggtaggaatacaaacgaactagtgcgtgcaccta

SEQ ID NO: 782975 - DNA, 517 bp, Homo sapiens
  misc_feature: HIJSMM301DWBBW.16.66.F11.1.454.light.4.raw
  modified_base (463)..(463): a, c, t, g, unknown or other
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggcccctctggggtccctcctcggttttctggctccatcgacgggtcctccactactgcctccctcaccatctctggactgaagactgaggacgaggctgactactactgtcagtcttatgataacaccagggtggtgttcgggcggagggaccaagctggccgtctaggtcngcccaaggctgccccctcggtcactctcgttcccacccttcctcgagtagtaca

SEQ ID NO: 782976 - DNA, 512 bp, Homo sapiens
  misc_feature: HIJSMM301ATBAM.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaaggccggggatgaggccgactattactgtcaggtgtgggatagtagtggtgatcatccatacgtcttcggaacgtggacgaaggtctccgtcctacgtcagccacggccaaccccactcgtcactctcgttcccta

SEQ ID NO: 782977 - DNA, 492 bp, Homo sapiens
  misc_feature: HIJSMM301APQ05.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggacgggaccgaaggcggagatcagacgaactgtggctgcaccatctgtcttcta

SEQ ID NO: 782978 - DNA, 489 bp, Homo sapiens
  misc_feature: HIJSMM301EE0QJ.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccaggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacaccttttggccaggggaccaaactggacaatcaaacgaactgtggctgcaccatctgtt

SEQ ID NO: 782979 - DNA, 489 bp, Homo sapiens
  misc_feature: HIJSMM301AMNRW.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagtattttgctagtttattactgtcagcagtatcatgactggccgctcaccttcggccaagggacacgactggagaattaaacgaacgtagtggctgcaccat

SEQ ID NO: 782980 - DNA, 526 bp, Homo sapiens
  misc_feature: HIJSMM301EQ5M9.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccgttggggcaaagctcgccctgacactgtctggtgtgcagcctgaggacgaggctgactattactgcctactcttactttggtggtgctgtgctagttcggcggacgggaccaagcctgaccgtcttaagtcacgcccaaggctcgccccctcggtcactctcgttcccaccctcctaccc

SEQ ID NO: 782981 - DNA, 495 bp, Homo sapiens
  misc_feature: HIJSMM301ES3N3.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacactacttagcctggttgcagcacaaacctggccaggctcccaggctcctcatctatgctgcatccatcagggccactggcatcccaggccagattcagtggcagtgggtctgggacagacttcactctcaccatcagcagactggagcctgaagtattttgcagttctattactgtcagcagtatggtcaccgtcccaagtaacttttggccgaggggaccgaagcgtaggagatacaaacgaactgtggctgcaccat

SEQ ID NO: 782982 - DNA, 504 bp, Homo sapiens
  misc_feature: HIJSMM301ALNNW.3.33.C11.1.454.light.4.raw
  modified_base (363)..(363): a, c, t, g, unknown or other
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacatttggtgattataactatgtctcctggtaccagcagcacccaggcaaagcccccaaactcatgatttatgaggtcacaaagcggccctcgaggggtccctgatcgcttctctgcctcaagtctggcaacncggcctccctgaccgtctctgggctccagcctgaggatgaggctgattattactgcagctcatatgcaggcatcaacacttgtttcggcggagggaccaagctgacccgtctaggtcacgcccgaaggcctcgtccccccg

SEQ ID NO: 782983 - DNA, 505 bp, Homo sapiens
  misc_feature: HIJSMM301ADB8H.48.27.C05.1.454.light.4.raw
agtatacatacacgaccggtgctcgatttagacgcgatcgaagggtttgggggaagagctgctcagttaggacccagagggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaaagctggccaggctcccaggctcctcatatatgatgtttctaccagggccactggcattccagacaggttcagtggcagtgggtctgggacagacttcactctcaccatcaacagattggagcctgaagactctgcagtctatttctgtcagcaatatcgcagttcagtctcgtactacttttggccaggggacccacggctggagtatcgaaacgaactgtaggctggcaccatctgtctt

SEQ ID NO: 782984 - DNA, 505 bp, Homo sapiens
  misc_feature: HIJSMM301BZ0JG.18.59.F04.1.454.light.4.raw
  modified_base (448)..(448): a, c, t, g, unknown or other
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctntgtcttcggaactgggaccaaggtcaaccgtccaggtcagcccaaggcccaacccca

SEQ ID NO: 782985 - DNA, 490 bp, Homo sapiens
  misc_feature: HIJSMM301AOLV7.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcgaggcgtgggacatcagcagtgtaggtgggttttcggcgggacgggaccgaacgctgaccgtacctaacgtcagaccccgg

SEQ ID NO: 782986 - DNA, 504 bp, Homo sapiens
  misc_feature: HIJSMM301AUPCF.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattaactgtctacaagattacaattaccctcggacgtcggtccgacgggaccgaacggaggaagtacaaaacgaaactaacgtggtacgtgacgacctaa

SEQ ID NO: 782987 - DNA, 508 bp, Homo sapiens
  misc_feature: HIJSMM301AULOH.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggtattttgcaacttactactgtcagcaggctaacaggctcgccccccaaccttccggacccgagggggaccacgacctgggaataagttaaaaccgaacttggtggcctgaccaccatcctgtt

SEQ ID NO: 782988 - DNA, 519 bp, Homo sapiens
  misc_feature: HIJSMM301DUKNO.9.12.B01.1.454.light.4.raw
  modified_base (432)..(432): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggcttccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtctaacagttttccncgggcgttcggccgtaagggaccaagggtggaaagtacaaacgaacgtacgtggctggcctaccgactctgtctctatctttccccg

SEQ ID NO: 782989 - DNA, 502 bp, Homo sapiens
  misc_feature: HIJSMM301ARUX2.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctccatttgcaggcagccgtatactcttcggcggagggaccaagctgaccgtcctaggtcagcccaaggctgccccctc

SEQ ID NO: 782990 - DNA, 482 bp, Homo sapiens
  misc_feature: HIJSMM301EF9CA.49.53.E09.1.454.light.4.raw
agtcgagagacacgaccggtgctcgatttagagagagtgtgttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcacatcagcagcctgcagtctgaagattttgcagtttattactgtcagcagtataattactggctcgttttaggccaggggaccaagctggagatcaagcgaactgtggctgcaccat

SEQ ID NO: 782991 - DNA, 447 bp, Homo sapiens; identical to SEQ ID NO: 535201
  misc_feature: HIJSMM301AYU2D.18.9.A09.1.454.light.4.raw

SEQ ID NO: 782992 - DNA, 504 bp, Homo sapiens
  misc_feature: HIJSMM301D9UMN.27.78.H01.1.454.light.4.raw
  modified_base (466)..(466): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttccaccctcaccatcaatagcctggaagctgaagatgctgcaacttattactgtcatcagatactactttacctcaagtnatcaccttcgccaagggacacgactggagattaaaacg

SEQ ID NO: 782993 - DNA, 498 bp, Homo sapiens
  misc_feature: HIJSMM301C2HT4.43.33.C11.1.454.light.4.raw
  modified_base (314)..(314): a, c, t, g, unknown or other
  modified_base (392)..(392): a, c, t, g, unknown or other
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtctacccttttttgccgggcgagtcggcccattgacgactgtttggcctggtatcgcgtgagaccagggcaacctcctcaacttctgatataccgttcatcgctgttncacgttggggtcccacctcggttcagtggcaacggctctgagacagattttctctcgtcatcactggtctacagtacngacgacggcgcaatgtacttctgtcaacactatgcctcctcccccctacaatttcggtctaggggacctaagttagaacaatcaatcgaactgtggactgcaccta

SEQ ID NO: 782994 - DNA, 532 bp, Homo sapiens
  misc_feature: HIJSMM301A57FG.12.21.B10.1.454.light.4.raw
  modified_base (477)..(477): a, c, t, g, unknown or other
atacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacggaggctcattactactgctgctcattatggaggttatagcacttgggtgttcgggtacgggcgggacctaaaggngaccggtcctaagtcagcccaaggctcgccccctcggtcactctgttcccaccct

SEQ ID NO: 782995 - DNA, 518 bp, Homo sapiens
  misc_feature: HIJSMM301D0X2G.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagtttaaccacttatgttacttcggaaatttggggacgtaccggtcaccgtcctaggtccaggcccaacgggcccaacccccgta

SEQ ID NO: 782996 - DNA, 517 bp, Homo sapiens
  misc_feature: HIJSMM301B8HQW.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctcctgaccatctctggactccagactgaggacgaggctgattatactgctgctcatatacgagggacagacattatttgggttgttcggcggacgggaccaaggctgaccgtcctgcgtcacgcccaaggcctgccccctcggtcactcg

SEQ ID NO: 782997 - DNA, 513 bp, Homo sapiens; identical to SEQ ID NO: 600196
  misc_feature: HIJSMM301AXYWD.40.12.B01.1.454.light.4.raw

SEQ ID NO: 782998 - DNA, 529 bp, Homo sapiens
  misc_feature: HIJSMM301B0BS7.40.46.E02.1.454.light.4.raw
tctagcgactcacgaccggtgctcgatttagactcatctacagggaaaggggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatccaccagggtcgaggccggagatggaggccgactatttttcgtcacgtgtggcacgttagtcatcacgttcttcggaactgggaccacggtcaccgtcctaagtcagcccaaggccaaaccccactgtcacttctcgttccccaccctccctcacgtcgctag

SEQ ID NO: 782999 - DNA, 503 bp, Homo sapiens
  misc_feature: HIJSMM301BCRAE.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtactttcggcggaggccaagctgaccgtcctgggtcagcccaaggctgccccctcggtctacg

SEQ ID NO: 783000 - DNA, 373 bp, Homo sapiens
  misc_feature: HIJSMM301AIRXL.41.34.D01.1.454.light.4.raw
tctatactatcacgaccggtgctcgatttagatcgtctgtgttgggtttgggggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagccccctaaattcctgatctatcaggcatctaatttggaaaggtggggtcccatcaaggtttagcggcagtggatcgtgggacagaatttcactctcacga

SEQ ID NO: 783001 - DNA, 520 bp, Homo sapiens
  misc_feature: HIJSMM301A2N6X.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttggaactgggaccaaggtcaccgtcctaggtcagcccaaggcccaaccccactgtcactcctgttcccgccctcctccgtgt

SEQ ID NO: 783002 - DNA, 500 bp, Homo sapiens
  misc_feature: HIJSMM301D29FS.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagttactactttaccctcaagtgaatcaccttcggaccaagggacacgactcggagaattaaacgaactgtggctgcaccatctgtctt

SEQ ID NO: 783003 - DNA, 496 bp, Homo sapiens
  misc_feature: HIJSMM301CX7M9.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactattctgtcacacgtgggacatgggcactgccgatcttcggcggagggaccaaggctgaccgtcctgggtcagcccaaggctgcccctcggtcactcc

SEQ ID NO: 783004 - DNA, 498 bp, Homo sapiens
  misc_feature: HIJSMM301C423S.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcaggtggcagtgggtctgggacagacttcactctcaccatcagcagactggagcctgaggattttgcagtgtattactgtcagcagtatcataggtcaaacaccttcggccaagggacacgactggagattaaaggaactagtggctgcaccatctcgtcttctatcttccccg

SEQ ID NO: 783005 - DNA, 524 bp, Homo sapiens
  misc_feature: HIJSMM301DQC5P.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattatttgtagttcatatacaaccagtgacacttgggtgttcgggcggagggaccaggctgaccgtcctaggtcagcccaaggctgccccctcggtcactctgttcccgccct

SEQ ID NO: 783006 - DNA, 490 bp, Homo sapiens
  misc_feature: HIJSMM301C9EIR.41.2.A02.1.454.light.4.raw
tctatactatcacgaccggtgctcgatttagactcatctacaggggcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcacatattactgtcaacagtctcatggtctcccccttagtttcggcggtaggaccaaggttgagatacaacgaactgtggctgcaccatctgtcttcatcttccccg

SEQ ID NO: 783007 - DNA, 492 bp, Homo sapiens
  misc_feature: HIJSMM301BI7PM.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcccggccaggcccctgtcttgcttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaccgtcctaggtcagcccaaggctgccccctc

SEQ ID NO: 783008 - DNA, 506 bp, Homo sapiens
  misc_feature: HIJSMM301ASUXL.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaaccccactcgtcactctcgttcccaccctt

SEQ ID NO: 783009 - DNA, 515 bp, Homo sapiens; identical to SEQ ID NO: 553540
  misc_feature: HIJSMM301DWZ05.22.36.D03.1.454.light.4.raw

SEQ ID NO: 783010 - DNA, 508 bp, Homo sapiens
  misc_feature: HIJSMM301EH58A.47.83.H06.1.454.light.4.raw
  modified_base (364)..(364): a, c, t, g, unknown or other
agctcacgtacacgaccggtgctcgatttagatcacgtgcgtcggcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgntcgcttctctggttccatccttgggaacaaagctgccctcaccatcgcgggggcccaggcagatgatgagtgtgattattactgtgtgctctatatgggcagtggcgtttgggtgttcggcggagggaccaagctgaccgttcg

SEQ ID NO: 783011 - DNA, 494 bp, Homo sapiens
  misc_feature: HIJSMM301D1H42.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggacaaggtcaccgtcctaggtcagcccaaggccaaccc

SEQ ID NO: 783012 - DNA, 497 bp, Homo sapiens
  misc_feature: HIJSMM301AO6X4.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacaggaattcactctcaccatccgcagcctgcagcctgaagattttgcaacttattactgccaacagtataatagcaattctccgtggacgttcggccaagggaccgagggtggatatcaaacgaactgtggctgcaccatctgtcttcatt

SEQ ID NO: 783013 - DNA, 537 bp, Homo sapiens
  misc_feature: HIJSMM301AJ1LG.12.21.B10.1.454.light.4.raw
atacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttggggtgttcggcggccgggaccaaaggtgaccgtcctaaggtccagacccaaggcctcgcccccctcggtccaccttctcgttccccacccctt

SEQ ID NO: 783014 - DNA, 474 bp, Homo sapiens
  misc_feature: HIJSMM301CBZLQ.51.34.D01.1.454.light.4.raw
cgatcgtatacacgaccggtgctcgatttagatcgtctgtgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcactatttcactcctcaccatcagcagcctgcagcctgacgatgttgcaacttattactgtacaaaattataacagggccgttgcgctcacgttcgggcggggggaccgaaggtggagatc

SEQ ID NO: 783015 - DNA, 484 bp, Homo sapiens
  misc_feature: HIJSMM301AJ3H2.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagacttttggccgagggaccaagctggagatcaaacgaactgtggctgcaccat

SEQ ID NO: 783016 - DNA, 527 bp, Homo sapiens
  misc_feature: HIJSMM301AT6Q4.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcacttctaatttatcgaagatttttcgaagactcccgtggggtcccctttcggttttctggctccatcgacagtccctccaactccgcctcccttaccatatctgggctgaagagtgaggacgaggctgactacttctgtcagtcttatgatataaacaattatgtgataattggcggtagggaccgagggtgaccgtcctaggtcagcccaaggctcgccccctcggtcactctcgttcccgt

SEQ ID NO: 783017 - DNA, 531 bp, Homo sapiens
  misc_feature: HIJSMM301EK25H.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgacttagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacgttgggttgttcggcgggagggaccaggctgaccgtcctaggtcagcccaaggctgccccctcggtccactctcgttcccgccctcctc

SEQ ID NO: 783018 - DNA, 470 bp, Homo sapiens
  misc_feature: HIJSMM301DVFP4.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtacaaaagaatagcgctgccccgctcagtttcggcggagggaccaaggtggagataaccg

SEQ ID NO: 783019 - DNA, 503 bp, Homo sapiens
  misc_feature: HIJSMM301DMXM1.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaaggcgcctaatttataaggtttccaaccgggactctggggtcccagacagattcagcggcagtgggtcaggcactgatttcacactggaaatcagcaggtggaggctgaggatgttggggttattactgcatgcaactacacacggccgctcactttcggcggagggaccaaggtggagatcaaacgactagtggctgcacatctgtt

SEQ ID NO: 783020 - DNA, 500 bp, Homo sapiens
  misc_feature: HIJSMM301A64J5.10.79.H02.1.454.light.4.raw
  modified_base (485)..(485): a, c, t, g, unknown or other
catagtagtgcacgaccggtgctcgatttagtgtcacacgaaggggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggcctagggggaaccaagcgtggagatcaaacgaactgtggntgcaccatctgtctt

SEQ ID NO: 783021 - DNA, 497 bp, Homo sapiens
  misc_feature: HIJSMM301EFN3H.43.34.D01.1.454.light.4.raw
tgtgagtagtcacgaccggtgctcgatttagatcgtctgtgttgggtttgggcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggctaacacggcctccctgacaatctctgggctccaggctgaggacgaggctgattattattgctgcttcatatgcaggttagtacacttatcgtcttac

SEQ ID NO: 783022 - DNA, 469 bp, Homo sapiens
  misc_feature: HIJSMM301BO92R.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggcctcaggggtccctgaccgattctctggctccaagtctggcactcagcctcctgtcatcgctgggctcagctgacgatgaggctgattattattgccagtcctatgacacacctgcgtggttttgctgttcggcggcggc

SEQ ID NO: 783023 - DNA, 516 bp, Homo sapiens
  misc_feature: HIJSMM301AOHVS.9.71.G05.1.454.light.4.raw
tgatacgtctcacgaccggtgctcgatttagtgtcgtcgcaagagagagggggggggtcacaagaggcagcgctctcgggacgtctccaccatggcctgggatctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgatttattactgcagctcatatgctagttggtttcctcttttcaagattattccgggcgggagggaccgaggctgaccgtcctgagtcaagcccaaggctcgcccccccg

SEQ ID NO: 783024 - DNA, 512 bp, Homo sapiens
  misc_feature: HIJSMM301BWQ79.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgccaatggttgcacgcaaagcgggacccagaccctggagcctcagttggaagcagccgatccagcctgcggagcctgtgggcaggtcagccaaggctgccccctcggtcactctgtcccaccctcctccacg

SEQ ID NO: 783025 - DNA, 522 bp, Homo sapiens
  misc_feature: HIJSMM301ECUAK.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgctttttctggctccaagtctggcaacacggcctccctgaccatctctgggctccaggctgaggacgaggctgattatttctgcagctcatacacaaccggcaccactgtcgtggttttcggtggagggaccaagctgaccgtccgtaggtcagcccaaggctgccccctcggtcacttcc

SEQ ID NO: 783026 - DNA, 501 bp, Homo sapiens
  misc_feature: HIJSMM301ELNHA.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattatgtcaatcaacagacaccattggtacttatgtcttcggaactgcgacaaggtcaccggtcctgggtcagacccaacggcccaaccccactcgtcactcttccg

SEQ ID NO: 783027 - DNA, 517 bp, Homo sapiens
  misc_feature: HIJSMM301BSR6N.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccggtgggacgttcgggtacccgaagggacccaagggtaggaaaataccaaaacgaaacgtagttggctgcgacc

SEQ ID NO: 783028 - DNA, 502 bp, Homo sapiens
  misc_feature: HIJSMM301CR0I0.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccgaacggaccgagggtggagtatacaaacgaacctagtggctgcaccatctgtcttcattt

SEQ ID NO: 783029 - DNA, 483 bp, Homo sapiens
  misc_feature: HIJSMM301EECYV.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctacatgttggtgttcggcggaggacaagctgaccgtcctaggtcacg

SEQ ID NO: 783030 - DNA, 537 bp, Homo sapiens
  misc_feature: HIJSMM301BFJ0O.14.78.H01.1.454.light.4.raw
cgtctagtaccacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagtaactttgcttagttcgggcgggagggaccgtaagttacgacccggttcctaaggtcacgcccaaggcctcgccccctcggtcactctcgttcccccg

SEQ ID NO: 783031 - DNA, 534 bp, Homo sapiens
  misc_feature: HIJSMM301AQ30K.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctacatatggaggttatagctacttgggtgttcggcggtccgggaccaaaggtcgtaccgtcctaaacgtcacgcccaaggcctcgccccctcggtcactcctgttcccaccct

SEQ ID NO: 783032 - DNA, 468 bp, Homo sapiens
  misc_feature: HIJSMM301EYY1X.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagtattttactttcaccatcagcagcctgcagcctgaagatattgcaacatattactgtcagcagtatgataatctcccgatcaaccttcggccaagggacacgactggagacttaaacga

SEQ ID NO: 783033 - DNA, 496 bp, Homo sapiens
  misc_feature: HIJSMM301APY25.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaacggccaaccccactcgtcta

SEQ ID NO: 783034 - DNA, 528 bp, Homo sapiens
  misc_feature: HIJSMM301AIVMB.17.33.C11.1.454.light.4.raw
cgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctagttcggcgggaagggaccaagcgtgaccgtcttaagttcagcccaaggcctcgcccccgtcggtccactcctcgttcccctaccctccct

SEQ ID NO: 783035 - DNA, 498 bp, Homo sapiens
  misc_feature: HIJSMM301EJHJT.9.1.A01.1.454.light.4.raw
  modified_base (359)..(359): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagcccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactcncaccatcagcagactggagcctgaggattttgcagtgtattactgtcagcagtatcataggtcaaacaccttcggaccaagggtacacgtacgtggagtattaaggaaactgtggctgcacatctgtctcatcttcccg

SEQ ID NO: 783036 - DNA, 508 bp, Homo sapiens; identical to SEQ ID NO: 577978
  misc_feature: HIJSMM301BF83S.4.57.F02.1.454.light.4.raw

SEQ ID NO: 783037 - DNA, 491 bp, Homo sapiens
  misc_feature: HIJSMM301C0X0Z.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactatattgtcaatcagcagtcagcactaattcttatccgggtggttcggcggagggaccaaagctgaccgtcctaggtcagcccaaggctgccccctcggtcctacc

SEQ ID NO: 783038 - DNA, 512 bp, Homo sapiens
  misc_feature: HIJSMM301CH8IR.19.59.F04.1.454.light.4.raw
tactctcgtgcacgaccggtgctcgatttagtacacacacttagggattggggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcattttgacaataataagcgaccctcagggattcctgaccgattctctggctccaagtctggcacgtcagccaccctgggcatcaccggactccagactggggacgaggccgattattactgcggaacatgggatagctagcctgagtactgtgataatcggcggagggaccaagctgaccgtcctaggtcagcccaaggctgccccctggtccactctcgttcccg

SEQ ID NO: 783039 - DNA, 501 bp, Homo sapiens
  misc_feature: HIJSMM301AMMBC.10.17.B06.1.454.light.4.raw
  modified_base (192)..(192): a, c, t, g, unknown or other
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgtagtctgaagatttgcagtttattactgtcagcagtatgatacctggcctccgtacacttttggccggggaccaaggctggaaatacaagcgaactgtggctggcaccatctgtcttcatcttccccg

SEQ ID NO: 783040 - DNA, 507 bp, Homo sapiens; identical to SEQ ID NO: 563344
  misc_feature: HIJSMM301EEKTW.3.79.H02.1.454.light.4.raw

SEQ ID NO: 783041 - DNA, 523 bp, Homo sapiens
  misc_feature: HIJSMM301DQCBH.9.21.B10.1.454.light.4.raw
tgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctcaagtctggcaacacggcctccctgacaatctctgggctccgagtctgacgacgaggctgatttatacttgcagctcatatgcagtttggttcctctttcaagatagttcggcggtacggggaccagggctcggaccgtccgttgacgttcaagccccaagggctcgtccccccg

SEQ ID NO: 783042 - DNA, 489 bp, Homo sapiens
  misc_feature: HIJSMM301CVFD3.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgtattttgctcctccgagtcgcctacgttttcgggcggggggtaccgaagggtggacacgtacaaaccgaaacct

SEQ ID NO: 783043 - DNA, 522 bp, Homo sapiens
  misc_feature: HIJSMM301EWX8T.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtgctagtttattactgtcagcaagtattaataattcctccttcagacgttacgggcctaaaggggaccaaaggtaggaaaatacgtaaaaaccgaaacttgtacggcttggccaacc

SEQ ID NO: 783044 - DNA, 499 bp, Homo sapiens
  misc_feature: HIJSMM301C3XZE.3.78.H01.1.454.light.4.raw
agacgcactccacgaccggtgctcgatttagtgtgagtagtttgggtttgggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggcctcctcatctatgatgcatccaacagggccactggcatcccagccaggttcagtggcagtgggtctgggacagacttcactctcaccatcagcagcctagagcctgaagatttcgctagtttattactgtcagcagcgtagcaactggctgactcaccttcggccaagggacacggactggagattaaacgaactgtggctgcaccatctgtcttct

SEQ ID NO: 783045 - DNA, 501 bp, Homo sapiens
  misc_feature: HIJSMM301A6ILU.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattacttgcagctcatatacaagcagcagcactctcgtggtattcggcggagggaccaagctcgaccgtcctaggtcagccaaggctcccg

SEQ ID NO: 783046 - DNA, 510 bp, Homo sapiens
  misc_feature: HIJSMM301AH86N.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggaggaccaagctgaccgtctaagtcagccaaggctgccccctggtcactctgttcccgccctcct

SEQ ID NO: 783047 - DNA, 499 bp, Homo sapiens
  misc_feature: HIJSMM301A3COX.52.78.H01.1.454.light.4.raw
  modified_base (117)..(117): a, c, t, g, unknown or other
cgcagtacgacacgaccggtgctcgatttagtgtgagtagtttgggtttgggaggcagaactctgggtgtctcaccatggcctggatccctctacttctccccctcctcactctctncacaggctctggggcctcctatgaactgacacagccaccctcggtgtcagtgtcctcaggacagacggccaggatcacctgctctggagatattctgtcaaaccgttatgcttattggtaccagcagaagccaggccaggcccctgtgttggtgatatataaggacactgagaggccctcagggatccctgagcgattctctggctccactcagggacactagtcacgttgaccatcagtggagtccaggcagaggacgaggctgactaccactgtcaatcaacagacagcagtggttcttatgtcttcgcaactgggacaaggtcaccgtcctaggtcagcccaaggccaaccccactgtcactctcgttcccaccctcct

SEQ ID NO: 783048 - DNA, 478 bp, Homo sapiens
  misc_feature: HIJSMM301DSZ02.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcattttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggagatcaaacgaactgtgctgcac

SEQ ID NO: 783049 - DNA, 514 bp, Homo sapiens
  misc_feature: HIJSMM301AR4SN.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcgccctcaggggtttctaatcgcttctctggctccaagtctggcaacacggcctccctgacaatctctgggctccaggctgaggacgaggctgatttactactgctgctcatatgcaggtcgtatctcttatgtcttcggaactgggaccaaggtcaccgtccgtaggtcacgcccaaggacccaacccccactacgtcta

SEQ ID NO: 783050 - DNA, 498 bp, Homo sapiens
  misc_feature: HIJSMM301B28T1.40.20.B09.1.454.light.4.raw
tctagcgactcacgaccggtgctcgatttagtgtagtgtgaagggggcatcggaggtgcctcagccatggcatggatccctctcttcctcggcgtccttgcttactgcacaggatccgtggcctcctctgagttgactcagccaccctcagtgtccgtgtcccccggacagacagccagcatcacgtgctcaggagatgatttgaacaataaacatgcttgttggtatcaacagaaaccaggccagtcccctgttctggtcatctttgaggattcaaagcggccctcagggatccctgagcgattctctggctccaagtctgcgctcacagccactctgaccatcagcgggacccagcctatggatgaggctgactattattgtcagtcgtgggacagcagcacctcttcctatgtcttcggaactcgggacccaggtccaccgtcctcggtcacgcccaacggcccaaccccactcgtcactctcgttccccaccct

SEQ ID NO: 783051 - DNA, 500 bp, Homo sapiens
  misc_feature: HIJSMM301EVY9K.2.34.D01.1.454.light.4.raw
  modified_base (363)..(363): a, c, t, g, unknown or other
  modified_base (495)..(495): a, c, t, g, unknown or other
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagntgaggctgattattactgcagctcatatgcaggcagcaacaatgtggcattcggcggagggaccaagctgaccgtctgggtcagcccaaggctgccccctcggtcactctgttcctaccctcctcctgtcgngcgtc

SEQ ID NO: 783052 - DNA, 514 bp, Homo sapiens
  misc_feature: HIJSMM301BC6F5.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactatactgcctactctactttggtggtgctgtgctattcggcggagggaccaagcctgaccgtcttaagtcagcccaaggctcgccccctcggtcaccgtctgttccccta

SEQ ID NO: 783053 - DNA, 497 bp, Homo sapiens
  misc_feature: HIJSMM301EXJ0W.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagaattaaacgaactcgtaggctgcaccatctgtctt

SEQ ID NO: 783054 - DNA, 382 bp, Homo sapiens; identical to SEQ ID NO: 575433
  misc_feature: HIJSMM301A1ZFS.41.26.C04.1.454.light.4.raw

SEQ ID NO: 783055 - DNA, 497 bp, Homo sapiens
  misc_feature: HIJSMM301B7OXI.11.60.F05.1.454.light.4.raw
cgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccaggggaaagagccaccctctcctgcagggccagtcagagtattagcagcaacttagcctggtaccaacaaaacctggccaggctcccaggctcctcttctatggtgcatccaacagggccgctggtatcccagccaggttcagtggcagtgggtctgcgacagagttcactctcaccatcagcagtctgcagtctgaagtattttgctagtttattactgtcagcagtataatgactggcctcccacggtggtacgtccggaccgaagggaccgaaggtaggaatacaaacgaactgtaggctgcacca

SEQ ID NO: 783056 - DNA, 506 bp, Homo sapiens
  misc_feature: HIJSMM301A7W6Z.19.78.H01.1.454.light.4.raw
  modified_base (425)..(425): a, c, t, g, unknown or other
  modified_base (444)..(444): a, c, t, g, unknown or other
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctggaggacgaggctgattactactgctgctcatangcaggtctattctcttatntcttcggaactgggaccaaggtccaccgtcctaggtcagcccaaggccaaccccactgtcta

SEQ ID NO: 783057 - DNA, 455 bp, Homo sapiens; identical to SEQ ID NO: 580685
  misc_feature: HIJSMM301B2FHE.19.86.H09.1.454.light.4.raw

SEQ ID NO: 783058 - DNA, 384 bp, Homo sapiens; identical to SEQ ID NO: 604567
  misc_feature: HIJSMM301BKA96.41.26.C04.1.454.light.4.raw

SEQ ID NO: 783059 - DNA, 521 bp, Homo sapiens
  misc_feature: HIJSMM301DXB3N.46.67.G01.1.454.light.4.raw
actagcagtacacgaccggtgctcgatttagagtatacatattgggtttgggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcaacccgggatactactcctaccttccggcttggacatcgtggggccggtac

SEQ ID NO: 783060 - DNA, 494 bp, Homo sapiens
  misc_feature: HIJSMM301D0FFW.40.59.F04.1.454.light.4.raw
  modified_base (430)..(430): a, c, t, g, unknown or other
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccagggctatggatgaggctgtactattactagtcaggcgtgggacatcagcngtaggaggtggttttcggtcgggagggaacccgaagcgtcgacccgtcctaagtcgagaccccg

SEQ ID NO: 783061 - DNA, 501 bp, Homo sapiens
  misc_feature: HIJSMM301DPHMG.22.27.C05.1.454.light.4.raw
acatacgcgtcacgaccggtgctcgatttagacgcgatcgaagggtttggggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcgagtggcagcgggtctgggacagatttcactctcaccatcagcagcctgcaggctgaagatgtggcagtttatactgtcagcaatattatattcctccttcagacgttcggccgaagggaccaaggtggaatcgaaacaactgtggctgcacta

SEQ ID NO: 783062 - DNA, 504 bp, Homo sapiens
  misc_feature: HIJSMM301AEHJ7.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttattgtcttcggaactgggaccaaggtcaccgtcctaggtcagcccaaggccaaccccactgtcactctcgttcccacccctccctccacgagagta

SEQ ID NO: 783063 - DNA, 508 bp, Homo sapiens
  misc_feature: HIJSMM301EJ5M7.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttcactttcggcggagggaccaaggtggacctcaaacgaactgtggctgcaccatctgttcttcatcttcccgcct

SEQ ID NO: 783064 - DNA, 500 bp, Homo sapiens
  misc_feature: HIJSMM301CL1GI.41.53.E09.1.454.light.4.raw
  modified_base (448)..(448): a, c, t, g, unknown or other
  modified_base (466)..(466): a, c, t, g, unknown or other
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcccctgaccatctctgggctccgggctgaggacgaggctgattaattactgcagctcatatacaagacagcagcacntcgtggtattcggcgggnggaccaaggctgaccgtcctaggtcagcccaagg

SEQ ID NO: 783065 - DNA, 506 bp, Homo sapiens
  misc_feature: HIJSMM301D17PZ.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggaggaccaagctgaccgtccgtggtcacgcccaaggctcgccccctcggtcta

SEQ ID NO: 783066 - DNA, 510 bp, Homo sapiens
  misc_feature: HIJSMM301DFZ85.15.34.D01.1.454.light.4.raw
  modified_base (509)..(509): a, c, t, g, unknown or other
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactggaccgtcctaggtcagcccaaggctgccccctggtcactctgttcccaccctcctcgctacgtana

SEQ ID NO: 783067 - DNA, 517 bp, Homo sapiens
  misc_feature: HIJSMM301A4XZQ.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggacaacacggcctcctcgaccatctctgggctcgagtctgaggacgaggctgattacttctgtttgctcttagggcaactactgtcgtttgggtgttcggcggagggaccaagttgaccgtcctaggtcagcccaagctcgcccctcggtcacgtctgttccccg

SEQ ID NO: 783068 - DNA, 420 bp, Homo sapiens
  misc_feature: HIJSMM301ALB7Z.9.34.D01.1.454.light.4.raw
tgatacgtctcacgaccggtgctcgatttagatcgtctgtgttgggtttgggggctgttcctggaagttgttggtaccagtgtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaatgggaccaaggtcaccgtcctgggtcagcccaaggccaaccccactgtcactctgttcccacccctcctcagacgtatca

SEQ ID NO: 783069 - DNA, 497 bp, Homo sapiens
  misc_feature: HIJSMM301EJE7Y.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcgagaaaccggggcagtctcctaagttgctcatttactgggcgtctacccgggaatcccggggtccctgaccgattcagtggcagcgggtctgggacagatttcactctcaccatcagcagcctgcaggttgaagatgtggctagtttattactgtcagcagtattatactactcctctgacgttcggccaaggaccaaggtggagatcaaacgaacgtgtggctgcaccat

SEQ ID NO: 783070 - DNA, 384 bp, Homo sapiens; identical to SEQ ID NO: 762552
  misc_feature: HIJSMM301DJNE9.41.26.C04.1.454.light.4.raw

SEQ ID NO: 783071 - DNA, 504 bp, Homo sapiens
  misc_feature: HIJSMM301BYXU3.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcaggaggacgaggctgactattattgtcaatcaacagacaccattggtacttatgtcttacggacgtgcgaccaaggtcaccgtccgtgggtcagcccaacggcccaaccccactcgtcactcttccg

SEQ ID NO: 783072 - DNA, 513 bp, Homo sapiens
  misc_feature: HIJSMM301DPC8O.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttgggggcaaagctgccctgacactgtctggtgtgcagcctgaggacgaggctgactattactgcctactctactttggtggtgctgtgctattcggcggagggaccaagcctgaccgtcttaagtcagcccaaggctgccccctggtcactctgttcccgccctcct

SEQ ID NO: 783073 - DNA, 513 bp, Homo sapiens
  misc_feature: HIJSMM301EAE9C.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaagctgccccctcggtcactctgttcccta

SEQ ID NO: 783074 - DNA, 542 bp, Homo sapiens
  misc_feature: HIJSMM301D0LBF.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggcctccctccttgggggcaaagctgccctgacactgtctggtgtgcagcctgaggacgaggctgactattactgcctactctactttggtgtgctgtgctagttcggcggagggaccaagcctgaccgttcttaaagtcacgccccaaagggtcctcggcccccccgtcggtccacttctcgtttcccccaacccccgttcctta

SEQ ID NO: 783075 - DNA, 505 bp, Homo sapiens
  misc_feature: HIJSMM301ATXWI.13.55.E11.1.454.light.4.raw
tcacgtactacacgaccggtgctcgatttagcactcgcacgttgggtttgggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctccaaggcgcctaatttataatgtttttacccgggactctggggtcccagacagattcagcggcagtgggtcaggcactgatttcacattgaaaatcaccagggtggaggctgaggatgttgggatttattactgcatgcaagctacatttctggcctttcactttcggccctgggaccaaagtggataccaatcgaactgtgctgcaccatctgtt

SEQ ID NO: 783076 - DNA, 480 bp, Homo sapiens; identical to SEQ ID NO: 535975
  misc_feature: HIJSMM301EQQ35.51.60.F05.1.454.light.4.raw

SEQ ID NO: 783077 - DNA, 497 bp, Homo sapiens
  misc_feature: HIJSMM301AHAOK.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccagggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtactacttttgggccgggggtaccaacgctggaaatcaagcgaactgtggctgcaccatctgtcttcat

SEQ ID NO: 783078 - DNA, 513 bp, Homo sapiens
  misc_feature: HIJSMM301BVDTN.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctcgttccccg

SEQ ID NO: 783079 - DNA, 487 bp, Homo sapiens
  misc_feature: HIJSMM301BHREW.40.86.H09.1.454.light.4.raw
tctagcgactcacgaccggtgctcgatttagtgctatagacttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttatactgtcaacaatattctggtcaatctcatttcgtttcggcggacgggaccaaggtggagatcagaacgaa

SEQ ID NO: 783080 - DNA, 513 bp, Homo sapiens
  misc_feature: HIJSMM301EI2O2.43.34.D01.1.454.light.4.raw
  modified_base (363)..(363): a, c, t, g, unknown or other
tgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacncggcctccctgacaatctctgggctccaggctgaggacggaggctgattattattgctgctcatatgcaggtagttacacttatgtctttcggaattggggacgacggtctaacccgtcctaggtcaagcccaaaggcccaacccctacg

SEQ ID NO: 783081 - DNA, 497 bp, Homo sapiens
  misc_feature: HIJSMM301EIEYO.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgctagtttatttctgccagcaatataattactggcctgcgtcgacgttcggccacgggaccaaggtggaaatacgaaacgaactgtggctgcaccatctgtct

SEQ ID NO: 783082 - DNA, 502 bp, Homo sapiens
  misc_feature: HIJSMM301E1IRP.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccggactctggggtcccagacagattcagcggcagtgggtcagacactgatttcacactgaaaatcagcagggtgaggctgaggatggttcggggtttactactgcatgcgagggtacactcgtggccgttcgtacgttttggccgaggggaccaaacgtggaatatacagacgaactggtggctgcta

SEQ ID NO: 783083 - DNA, 510 bp, Homo sapiens
  misc_feature: HIJSMM301ATDSQ.3.37.D04.1.454.light.4.raw
agacgcactccacgaccggtgctcgatttagtagcatactgttgggtttgggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccagggtgaggacgaggctgattattactgcagctcattacaagcagcaccactcaggtcttcggaactgggactaaggtcaccgtcctaggtcagcccaaggacccaacccactcgtcact

SEQ ID NO: 783084 - DNA, 512 bp, Homo sapiens
  misc_feature: HIJSMM301DGUL5.7.86.H09.1.454.light.4.raw
  modified_base (503)..(503): a, c, t, g, unknown or other
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtcagagtgttggcgcctacgtagcctggtaccaacagaaacctggccaggctcccaggccccctcatctatggtgcatccaacagggccactggcatcccagccaggttcagtggcagtgggtctgggacagacttcactctcaccatcatcagcctggagcctgaagatgttgctagtttattactgtcaacatcgtaccgagtggccgtccgggggccacgtttcggcccgtgggaccgaaagtggatatacaaacgaactgtggntgcaccatc

SEQ ID NO: 783085 - DNA, 487 bp, Homo sapiens
  misc_feature: HIJSMM301BLDWE.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgctgtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgctagtctattactgtcagcagtatggtcacgtcccaagaacttttggccaggggaccaagctggagatcaaacgaactgtggctgcaccat

SEQ ID NO: 783086 - DNA, 493 bp, Homo sapiens
  misc_feature: HIJSMM301CFNRA.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcagggtttctaatcgcttctctggctccaagtctggcaacacggcctccctgaccatctctgggctccaggctgaggacgaggggtgattattactgcagctcatatagaagtggcagcactctcgtattcggcggtggaccaagctgaccgtcctaggtcagcccaagg

SEQ ID NO: 783087 - DNA, 492 bp, Homo sapiens
  misc_feature: HIJSMM301AF3SC.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgcccccgtcggtccacctctcgttcccgcccctcctccgctacgtaga

SEQ ID NO: 783088 - DNA, 524 bp, Homo sapiens
  misc_feature: HIJSMM301ANK40.17.37.D04.1.454.light.4.raw
cgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggactccctgagcgattctctggctccaactctgggaacacggccaccctgaccatcggcagggtcgaagccggggatggaggccgactattattgtcgaggtgtggggatagtagtagtgatcatggtggtagttcggcgggagggaccaagctgtaccgtccttggtcacgtccaaggctgccccctcggtcactctgttccccta

SEQ ID NO: 783089 - DNA, 488 bp, Homo sapiens; identical to SEQ ID NO: 679655
  misc_feature: HIJSMM301EU7JE.3.77.G11.1.454.light.4.raw

SEQ ID NO: 783090 - DNA, 491 bp, Homo sapiens
  misc_feature: HIJSMM301EE003.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagtatttgctaacttattactgtctacaagattcttcttaccctcggacgttcggtccgacgggaccgacggtcggatagtctaagcgaacgtcgtggcgtgcacc

SEQ ID NO: 783091 - DNA, 517 bp, Homo sapiens
  misc_feature: HIJSMM301A0DY5.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgatttatttctgcagctcatacacaaccggcaccatgtcgtggttttcggtggaggaccaagctgaccgtcctaggtcagcccaaggctgccccctcggtcactc

SEQ ID NO: 783092 - DNA, 494 bp, Homo sapiens
  misc_feature: HIJSMM301CVX97.5.40.D07.1.454.light.4.raw
  modified_base (492)..(492): a, c, t, g, unknown or other
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccatcctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagcctgaagtattttgctaactttactattgtcaacaggacttaacacgtttcccctccgtaccgttcggccgaaggaacgacgactggagattaaacgaactagtggngt

SEQ ID NO: 783093 - DNA, 492 bp, Homo sapiens
  misc_feature: HIJSMM301DB3RM.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtacccaagaacttttggcctaggggaccaaggtctggagatacaaacgaactagtggctgcaccat

SEQ ID NO: 783094 - DNA, 499 bp, Homo sapiens
  misc_feature: HIJSMM301ARQD1.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggactgggaccaaggtcaccgtcctaggtcagcccaaggccaaccccactgtcactctcgttcccaccctcctccacgagagta

SEQ ID NO: 783095 - DNA, 491 bp, Homo sapiens
  misc_feature: HIJSMM301BLX0Z.47.46.E02.1.454.light.4.raw
  modified_base (462)..(462): a, c, t, g, unknown or other
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctggaaagtatttttgctagttttattactgtcagcagtatcataactgccgctcaccttcggccaagggaccacgacnggagattaaacgaactgtggctgcaccat

SEQ ID NO: 783096 - DNA, 477 bp, Homo sapiens; identical to SEQ ID NO: 693917
  misc_feature: HIJSMM301ARZPN.13.76.G10.1.454.light.4.raw

SEQ ID NO: 783097 - DNA, 503 bp, Homo sapiens
  misc_feature: HIJSMM301BFW28.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatcctactcatttactgggcctctacccgggaatccggggtctctggccgattcagtgccagcgggtctgggacagagttcactctcaccatcagcagcctgcaggctgaagatgtggcagtttatactgtcagcaattatttcgtgcttccgtactacttttggtcaggggtacccaggttggagtatcaggacgaaactggtggctggcacatctgtcttcatcttccga

SEQ ID NO: 783098 - DNA, 509 bp, Homo sapiens
  misc_feature: HIJSMM301DG30P.3.79.H02.1.454.light.4.raw
agacgcactccacgaccggtgctcgatttagtgtcacacgaagggaaagggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttgggtggagggaccaagctgaccgtctaggtcagcccaaggctcgccccctcggt

SEQ ID NO: 783099 - DNA, 508 bp, Homo sapiens
  misc_feature: HIJSMM301C3UHB.18.26.C04.1.454.light.4.raw
tacgagtatgcacgaccggtgctcgatttagtctagcgactttgggtttggggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgctaacttactattgtacaacaggctgacaggttcccgctgactttcggcggtagggaccaaggtagagatacaaaggaactgtggctgcaccatctgtcttcactctcccgcctac

SEQ ID NO: 783100 - DNA, 495 bp, Homo sapiens; identical to SEQ ID NO: 622278
  misc_feature: HIJSMM301DNAZ2.27.78.H01.1.454.light.4.raw

SEQ ID NO: 783101 - DNA, 525 bp, Homo sapiens
  misc_feature: HIJSMM301EY4AU.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatcgtgggacagtatttcactctcaccgtcagcagtctgcaactgaagattttgctaacttactactgtacaacagagtttaccacgtacccccctctaacctttcgggcggtaagggaccgaaaggcgggaagatacgaggtaaccgaactcggtggcctggtacaccctatccttcgttccttctaa

SEQ ID NO: 783102 - DNA, 516 bp, Homo sapiens
  misc_feature: HIJSMM301COXXN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaacagttttctcgggcgttcgtccgaaggtacgaacgtaggaaagtacgaaacaactagtaggcgtaggctaccatactcgtcttctatcttccccg

SEQ ID NO: 783103 - DNA, 520 bp, Homo sapiens
  misc_feature: HIJSMM301AT9D4.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaaggcccccaaactcttgatttatgatgtctctaatcggccctccggcgtttctattcgcttctctggctccaagtctggcaacacggcctccctgaccatctctggactccagactgaggacgaggctgattattactgctgctcatatacgagggggaccagctattatttgggtggttcgggcggagggaccaagctgaccgtctgcgtcagcccaaggctcgccccctcggtctactc

SEQ ID NO: 783104 - DNA, 518 bp, Homo sapiens
  misc_feature: HIJSMM301B7Z0G.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctcctcgttgggggcaaagctgccctgaccctttcgggtgcgcagcctgaggatgaggctgagtattactgcttgctctcctatagtggtgttcgggtgttcggcggagggaccaaggctgaccgtcctaggtcagcccaaggctcgccccctcgggtccactcctgttcccaccctcctcctagtctacg

SEQ ID NO: 783105 - DNA, 486 bp, Homo sapiens
  misc_feature: HIJSMM301AQJ86.15.1.A01.1.454.light.4.raw
  modified_base (469)..(469): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcacgcccaaggctgccccctcggtcactcctgttcccnccctcctcgctacgtga

SEQ ID NO: 783106 - DNA, 490 bp, Homo sapiens
  misc_feature: HIJSMM301CUAQ4.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctggacagatttcactctcacgtcagcagtctgcaactgaagattttgcaacttactactgtcaacagagttacagtacccccctcacctttcggtcgagggaccaaggcggaggatcagacgaactcgtggctgcaccatcctgtcttcta

SEQ ID NO: 783107 - DNA, 507 bp, Homo sapiens
  misc_feature: HIJSMM301AIGE5.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagtgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctcgccccctcggtcactctccg

SEQ ID NO: 783108 - DNA, 511 bp, Homo sapiens
  misc_feature: HIJSMM301EF5DY.47.85.H08.1.454.light.4.raw
  modified_base (503)..(503): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctcctggtaccaacaacacccaggcaaagccccaaactcataatttatgacgtcaatgttcgcccctcaggggtttctcatcgcttctctggctccaaatctggcaacacggcctccctgaccatctctgggctcgagtctggaggacgaggctgattacttctgttgctcttggcaactactgtcgtttgggtgttcggcggagggaccaagttcgaccgtcctaggtcagcccaaggcctgccccctccggtcnctctcgtt

SEQ ID NO: 783109 - DNA, 508 bp, Homo sapiens
  misc_feature: HIJSMM301D8N7O.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaattggtcatctatgaagacgacaaacgaccctccgggatccctgagagattctctggctccagctcagggactatggccaccttgactatcagtgggcccaagtggaggatggaagctagacttactactgttactcaatagagaacagtgattaatttctgggtgttcggcggagggaccaaactgaccgtctaggtcacgccaaggctcgcccccgtcggtcactctcgtt

SEQ ID NO: 783110 - DNA, 508 bp, Homo sapiens
  misc_feature: HIJSMM301ECJUH.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctctttatgtcttcggaactgggaccaaggttcaccgtcctaggtcagcccaaggccaaccccactgtcta

SEQ ID NO: 783111 - DNA, 486 bp, Homo sapiens
  misc_feature: HIJSMM301AQZ6Q.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctctgcatagtaatggagacaactatttggattggtacctgcagaagccagggcagtctccacagctcatcatctattggttctaatcgggcctccggggtcctgacaggttcagtggcagtggatcaggcacagtattttacactagaaaatcagcagagtggaggctgaggatggttgggcttctattattgcatgcagctctacaacgttccgctcacttcgggcggagggaccgaaggtggagatacaaacgaa

SEQ ID NO: 783112 - DNA, 521 bp, Homo sapiens
  misc_feature: HIJSMM301EIKOJ.43.23.C01.1.454.light.4.raw
tgtgagtagtcacgaccggtgctcgatttagtacacgtgattagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctggaggacgaggctgactattactgcctgctcatatatggtggcgcggtgggtgttcggcggagggaccaagctgaccgtcctgggtcagcccaaggctcgccccctcggtcactctcgttccccaccctcctcta

SEQ ID NO: 783113 - DNA, 528 bp, Homo sapiens
  misc_feature: HIJSMM301AET6R.43.1.A01.1.454.light.4.raw
tgtgagtagtcacgaccggtgctcgatttagacgtctcatcaggggcagtttcagctgtgggtagagaagacaggactcaggacaatctccgagcatggccagcttccctctcctcctcaccctcctcactcactgtgcagggtcctgggcccagtctgtcctgactcagccaccctcagcgtctgggacccccgggcagacggtgaccatctcttgttctggaagcagttccaacatcgggaaagtaataatgtgaattggtaccggcaactcccaggaacggcccccaaactcctcatgcatagtaatgatcatcggcccccaggggtccctgaccgaatctctggctccaggtctggcgcctcagcctccctggtcatcagtgggctccaatctgaggatgaggctgactattactgttcagcgtgggatgccacgcccgaactggttgggtcgttcgggcggggggacgtcgagttgaccgtcctacggtcagcccaacggcctcgccccctccggtcaccttc

SEQ ID NO: 783114 - DNA, 534 bp, Homo sapiens
  misc_feature: HIJSMM301CALMU.15.34.D01.1.454.light.4.raw
tctacgtagccacgaccggtgctcgatttagatcgtctgtgttgggtttggggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttggaacaaagctgccctcaccatcacgggggcccaggcagacgatgaatgtgattatcactgcgtcctttatgtgggcgtggcagtttgggtgttcggcggagggaccaaacgtacgaccgtacctacggtcacggacccgaaaggcctcgcccccctccgggtccacgtcttccg

SEQ ID NO: 783115 - DNA, 466 bp, Homo sapiens
  misc_feature: HIJSMM301A9MJ0.49.9.A09.1.454.light.4.raw
  modified_base (424)..(424): a, c, t, g, unknown or other
agtcgagagacacgaccggtgctcgatttagcgagacgcgcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctcgtggaagtggctctgggacactattttacttcaccatcagcagactgcagcctgaagataattgcaacatattactgtcaacagtatgataatcctccnctcactttcggcggtagggaccaaggtggaagatacaacgaa

SEQ ID NO: 783116 - DNA, 491 bp, Homo sapiens
  misc_feature: HIJSMM301CUSFC.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcactctcaccatcagcagactggagcctgaagtattttgcagtctattactgtcagcagtatggtcaccgtccaagtaacttttggccaggggaccaagctaggagatacaaacgaactgtggctgcaccat

SEQ ID NO: 783117 - DNA, 513 bp, Homo sapiens
  misc_feature: HIJSMM301CZHZK.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctaatggtaaaaacaaccggcctcagggatcccagaccgattctctggctcctactcaggaaacacagcttccttgaccatcatggggctcgaggcggaagatgaggctgactattattgtaagtccgggacagaagtggtaatacatggtgttcggacggagggaccaagctgaaccgtcctacgtccagcccaaggcctgccccctcggtcactcttccg

SEQ ID NO: 783118 - DNA, 428 bp, Homo sapiens
  misc_feature: HIJSMM301EBJGM.51.38.D05.1.454.light.4.raw
cgatcgtatacacgaccggtgctcgatttagtatctgatagttgggtccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaaccgtcctaggtcagcccaaggctgccccctcggtcactctgttcccgccctcctctcgtagcact

SEQ ID NO: 783119 - DNA, 512 bp, Homo sapiens
  misc_feature: HIJSMM301BKVHR.17.33.C11.1.454.light.4.raw
  modified_base (433)..(433): a, c, t, g, unknown or other
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggaacccctgcccgattctcaggctccctccttggggcaaagctgccctgacactgtctggtgtgcagcctgaggacgaggctgactattactgcctactctactttggtggtnctgtgctattcggcggagggaccaagctgaccgtcttaagtcagcccaaggctcgccccctcggtcactctcgttcccg

SEQ ID NO: 783120 - DNA, 491 bp, Homo sapiens
  misc_feature: HIJSMM301BZFZ3.46.26.C04.1.454.light.4.raw
  modified_base (454)..(454): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggattggttgggcttctatttattagctatgcaagctctacaagtcccgctcnctttcggcggagggaccaagggtggagatcaaacgaa

SEQ ID NO: 783121 - DNA, 500 bp, Homo sapiens
  misc_feature: HIJSMM301DTK76.27.78.H01.1.454.light.4.raw
agcgtcgtctcacgaccggtgctcgatttagtgtgagtagtttgggtttggggatgagcaaaactgacgagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacacttgggtaccagcagaagccaggtcagtctccaaagctcctcatcaagtatgcttcccagtccttctcacggggtcccctcgaggttcagtggcagtggatctgggacacatttcaccctcaccatcaatagcctggaagctgaagatgctgcaacttattactgtcatcagagtactacttactcaagtgatccaccttcggccaagggacacgactggaagattaaaacgaactgtggctgacaccactctgtctt

SEQ ID NO: 783122 - DNA, 511 bp, Homo sapiens
  misc_feature: HIJSMM301A0UY2.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagccccaaactcatcatttttgaggtcactacgcgaccctcaggggtccctgatcgcttctctggctccaagtctggcaacacggcctccctgaccgtctctgggctccaggctgaggatcgaggctgattattactgcagctcatatgcaggcagcagcagtcccccatgtgatcttcggcggggggaccaagctcgccgtcctaggtcacgcccaaggctcgtccccccg

SEQ ID NO: 783123 - DNA, 495 bp, Homo sapiens
  misc_feature: HIJSMM301AP2YP.5.39.D06.1.454.light.4.raw
  modified_base (481)..(481): a, c, t, g, unknown or other
atcagacacgcacgaccggtgctcgatttagtgacatctcgcagttctttgggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatattattggtacgttcggcgacgggaccgaaggtcgaaatagaagacgaacgtagtggntgcaccactcttcg

SEQ ID NO: 783124 - DNA, 487 bp, Homo sapiens
  misc_feature: HIJSMM301A42OZ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggtagtggatctgggacagatttcactctcaccgtcagcagtctgcaacctgaagattttgcaacttactactgtcaacagagttacagtacccccctcacctttcggcggagggaccaaggcggagatcagacgaactgtggctgcaccatctgtctt

SEQ ID NO: 783125 - DNA, 502 bp, Homo sapiens
  misc_feature: HIJSMM301B3X59.12.82.H05.1.454.light.4.raw
  modified_base (193)..(193): a, c, t, g, unknown or other
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaanagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccaggggtccaagctggagatgaaacgaactgtggctgcaccatctgtcttcatccttccccg

SEQ ID NO: 783126 - DNA, 506 bp, Homo sapiens
  misc_feature: HIJSMM301C72RU.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagtatttttctctcgtcatcactggtctacagtctgacgacggcgcaatgtacttctgtcaacactatcgcctcctcccccctactaactttcggttcaggggaacccaagttagaacatacaatacgaactggtggctgctaccatctgttctt

SEQ ID NO: 783127 - DNA, 484 bp, Homo sapiens
  misc_feature: HIJSMM301EMV3O.5.39.D06.1.454.light.4.raw
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgaatggaggggtcccaccaacattcagcggcagtggatctgggacagagttcactctcacaatcagcagcctgcagcctgatgatcttggaacttattactgccaacaatataatagttattggacgttcggccacgggacgaaggtcgaaatagagacgaactgtaggctgcaccatactgt

SEQ ID NO: 783128 - DNA, 493 bp, Homo sapiens
  misc_feature: HIJSMM301BRFK4.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtcttattactgtcagcagtatggtcacgtcccaagaacttttggccaggggaccaagctggagatcaaacgactagtggctgcaccatcttcg

SEQ ID NO: 783129 - DNA, 526 bp, Homo sapiens
  misc_feature: HIJSMM301B6ZS6.40.27.C05.1.454.light.4.raw
  modified_base (465)..(465): a, c, t, g, unknown or other
tctagcgactcacgaccggtgctcgatttagacgcgatcgaagggtttgggggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagccctcctggccatcagtgggctccgggcccgaggatgaggcggattattattgtgtgtcatgggatgacagaatgaatggtccggtgttcgggcggagggaccgaggcngaccgtcctaggtcagcccaggctcgccccctcggtcactctgtttccgccctcctcagtc

SEQ ID NO: 783130 - DNA, 531 bp, Homo sapiens
  misc_feature: HIJSMM301BBZNN.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacgttgggtgttcgggcggagggaccgaggctgaccgtccgtaggtcacgcccaaggcctcgccccctcggtccactctcgttccccaccctt

SEQ ID NO: 783131 - DNA, 535 bp, Homo sapiens
  misc_feature: HIJSMM301DHBTT.52.68.G02.1.454.light.4.raw
  modified_base (446)..(446): a, c, t, g, unknown or other
  modified_base (521)..(521): a, c, t, g, unknown or other
cgcagtacgacacgaccggtgctcgatttagtcgatagtgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcattatttatggtgtcggtgaccggccctcaggggtttcgaatcacttctctggctccaagtccggcaacacggcctccctgaccatctctgggctccaggccgaggacgaggctgattattactgcgcctcatatacaaacaacaacaattgggngttcggcggagggaccaagctgaccgttcctagggtcagcccaaggctcgccccctcggtccactctcgttcccnccctcctctatacg

SEQ ID NO: 783132 - DNA, 484 bp, Homo sapiens; identical to SEQ ID NO: 738391
  misc_feature: HIJSMM301DN7PW.22.59.F04.1.454.light.4.raw

SEQ ID NO: 783133 - DNA, 512 bp, Homo sapiens
  misc_feature: HIJSMM301AM3R7.10.29.C07.1.454.light.4.raw
catagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctcctgaccatctctgggctccaggctgaggacgaggctgattattactgcagctcatatacaaccagcagcacttctgtattcggcggagggaccaagctgaccgtccgtaggtcagcccaaggctcggcccccttcggtctacc

SEQ ID NO: 783134 - DNA, 503 bp, Homo sapiens
  misc_feature: HIJSMM301AGC6Z.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctcaggctgaggacgaggctgattattactgcagctcatatacaagcaccagccactctctatgtacttcggaactgggaccaaggtcaccgtcctaggtcagcccaaggcccaaccc

SEQ ID NO: 783135 - DNA, 482 bp, Homo sapiens
  misc_feature: HIJSMM301EYZNH.13.76.G10.1.454.light.4.raw
tcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactcctcatcaatagtaacaacaatcggcccgcaggggtccctgaccgattctctggctccaggtctggcacctcagcctccctggtcatcactgggctccaggctgaggatgaggctgattatttctgccagtcctatgacagcagcctgagtgcttcggtacgttcgggccggggggacccac

SEQ ID NO: 783136 - DNA, 529 bp, Homo sapiens
  misc_feature: HIJSMM301ETUPG.41.87.H10.1.454.light.4.raw
tctatactatcacgaccggtgctcgatttagcagtactgcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcaggtattggcggaagggaccaagctgaccgtccgtgggtcacgcccaaggcctcgcccccttcggtcacttcctcgttccccgt

SEQ ID NO: 783137 - DNA, 479 bp, Homo sapiens
  misc_feature: HIJSMM301C9CS8.51.75.G09.1.454.light.4.raw
  modified_base (452)..(452): a, c, t, g, unknown or other
cgatcgtatacacgaccggtgctcgatttagtatagacatcaggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaacagtccccaaactcctcatttatgctaacaccaatcggccctcaggggtccctgcccgattctctggctccaggtctggcacctcagccctccctcggccatcactgggctccgggctgaggatgaggctgattattactgccagtcccatgacagcagcctgacgtgtnctggttcggcggagggaccaagctacg

SEQ ID NO: 783138 - DNA, 493 bp, Homo sapiens
  misc_feature: HIJSMM301ANY0T.4.57.F02.1.454.light.4.raw
agcactgtagcacgaccggtgctcgatttagctcgatatagttggggtttggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtactacaacctgaagattttgacaacttactactgtcaacagtagttacgactacccctccgctcacgtttcggcggagggaccaggtaggagatcaaacgaactggtgcgtgcacatctgtt

SEQ ID NO: 783139 - DNA, 514 bp, Homo sapiens
  misc_feature: HIJSMM301A6YKG.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagggtcagtcaccatctcctgcactggaggcagcagtgacgttggcggttataactatgtctcctggtatcaacaacaccccggcgaagcccccaaactcctcatttatgaggtcactaagcggccttaggggtccctgatcgcttctctggctccaagtctggcagaacggcctccctgaccgtctctgggctccaagctgaggatgaggctggattattactgcagctcatatgcaggcagcagcaatgttacttttcggcggagggaccaagctgaccgtccgtgggtcacgacccaaggctcgccccctcggtctaccg

SEQ ID NO: 783140 - DNA, 509 bp, Homo sapiens
  misc_feature: HIJSMM301EP9KV.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcggtgcgcagcctgaggatgaggctgagtattactgcttgctctcctatagtggtgttcgggtgttcggcggagggacaagctgaccgtcctaggtcacgcccaaggctcgccccctcggtcactctcgttcccaccctcctcgcctacgtacga

SEQ ID NO: 783141 - DNA, 493 bp, Homo sapiens
  misc_feature: HIJSMM301BHCMS.43.33.C11.1.454.light.4.raw
  modified_base (360)..(360): a, c, t, g, unknown or other
  modified_base (431)..(431): a, c, t, g, unknown or other
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccactcggttcagtggcaacggctctgagacagatttttcnctcgtcatcactggtctacagtctgacgacggcgcaatgtacttctgtcaacactatgcctctccccctanaactttcggtcacggggaccaagttagaacatcaatcgaactgtggctgcaccatctgtctt

SEQ ID NO: 783142 - DNA, 521 bp, Homo sapiens
  misc_feature: HIJSMM301BB8GO.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacctagggcactcatttatagtacaaacaacaaacactcctggacccctgcccgattctcaggctccctccttgggggcaaagctgcctgacactgtctggtgtgcagcctgaggacgaggcctgactattactgcctactctactttggtgtgctgtgctattcggcggaggaccaagctgacgtcttaagtcagcccaagctcgccccctacggtccacgtctcgttcccctaccctccctccc

SEQ ID NO: 783143 - DNA, 494 bp, Homo sapiens
  misc_feature: HIJSMM301DY3N8.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactagaaaatcagcagggtggaggctgagatgtcggggtttactactgcatgcgagggtacactctggccgttctacttttggccaggggaccaaactggatatcagacgaactgtggctgcacc

SEQ ID NO: 783144 - DNA, 505 bp, Homo sapiens
  misc_feature: HIJSMM301CU1UD.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcagggtccctgatcgcttctctgcctccaaggctggcaacacggcctccctgaccgtctctgggctccaggctgaggatgaggctgtattattattgcagctcatatgcaggcagttacaatgtgatattcggcggagggaccaaactgaccgtctaggtcagccaaggcctcgcccccgtcc

SEQ ID NO: 783145 - DNA, 508 bp, Homo sapiens; identical to SEQ ID NO: 570884
  misc_feature: HIJSMM301EQ9YS.18.78.H01.1.454.light.4.raw

SEQ ID NO: 783146 - DNA, 498 bp, Homo sapiens
  misc_feature: HIJSMM301EX3NY.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggcctgccccctcggtccactctcg

SEQ ID NO: 783147 - DNA, 494 bp, Homo sapiens
  misc_feature: HIJSMM301ASHHV.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgctaacttactactgtcaacagagttacacgtacccccctctacctttcggcggagggaccgaaggcggagatcagacgaactgtggctgcacatctgtcttcta

SEQ ID NO: 783148 - DNA, 499 bp, Homo sapiens
  misc_feature: HIJSMM301A2HKC.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgacccatctctgggctccaggctgaggtacgagggtgtattattactgcagctcatatagaagtggcagcactctcgtattcggcggtgggaccaagctgaccgtcctaggtcagcccaggctcgcccctc

SEQ ID NO: 783149 - DNA, 474 bp, Homo sapiens
  misc_feature: HIJSMM301A1N42.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtccccctgtgctggtcatctatcaagatgccaagcggccctcagggatccctgagcgattctctggctccaactctgggaactcagccactctgaccatcagccgggacccaggctatggatgaggctgactattactgtcagggcgtgggacagcagcactcgcccgctatgtcttcggaatgggacaaggtcaccgtctagtcacg

SEQ ID NO: 783150 - DNA, 518 bp, Homo sapiens
  misc_feature: HIJSMM301ASU28.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaacgcccccaaactcatcatttatgagaccactaagcggccctcaggggtttctgatcgcttctctgcctccaagtctggccacacggcctccctgacaatctctgggctccagactgaggacgagggtgattatactgctgctcatacggagggactagtaactttgctagttcggcggagggaccaagtgaccgtcaagtcagccaaggctgccccctcggtccactctcgttccccg

SEQ ID NO: 783151 - DNA, 496 bp, Homo sapiens
  misc_feature: HIJSMM301DYSDU.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttattactgtcatcagagtactacttttacctcaagtgatcaaccttcggccaagggacacgaactgga

SEQ ID NO: 783152 - DNA, 485 bp, Homo sapiens; identical to SEQ ID NO: 542261
  misc_feature: HIJSMM301AILJB.26.78.H01.1.454.light.4.raw

SEQ ID NO: 783153 - DNA, 494 bp, Homo sapiens
  misc_feature: HIJSMM301EVFE4.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcaggtgggtcaggcgctgatttcacactgagaatcagcagggtggaggctagaagatgtcggggtttattactgcatgcagggtacagtgtggccttcgctcgcagttcgggcggagggaccgaaggtaggagatcaaacgaa

SEQ ID NO: 783154 - DNA, 505 bp, Homo sapiens
  misc_feature: HIJSMM301AY89P.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgttcttcggaactgggaccaaggtcaccgtcctaggtcagcccaaggcccaaaccccact

SEQ ID NO: 783155 - DNA, 445 bp, Homo sapiens
  misc_feature: HIJSMM301ANY2B.7.18.B07.1.454.light.4.raw
cgtgtctctacacgaccggtgctcgatttagtcgctgcgtaagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggcttgttcggcggcgggaccaagttgaccgtcctacgtcagcccaaggctgccccctcggtcactctgttcccaccctcctctagagacacg

SEQ ID NO: 783156 - DNA, 451 bp, Homo sapiens
  misc_feature: HIJSMM301B58JL.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaacggccaaccccctctgtcactctcgttcccaccctccctccatactcgta

SEQ ID NO: 783157 - DNA, 515 bp, Homo sapiens
  misc_feature: HIJSMM301EB4PS.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagacccccgggccagactccacgcacgctcatctacaacacagacactcgctcttctggggtccctgatcgcttctctggttccatccttgggaacaaagctgccctcaccatccgcgggggcccaggcagatgatgagtgtgattattactgtgtgctctatatgggcagtggtcggtttgggtggttcggcggtagggaccaaggctggaccgttcg

SEQ ID NO: 783158 - DNA, 490 bp, Homo sapiens
  misc_feature: HIJSMM301APDCT.49.6.A06.1.454.light.4.raw
  modified_base (409)..(409): a, c, t, g, unknown or other
  modified_base (418)..(418): a, c, t, g, unknown or other
agtcgagagacacgaccggtgctcgatttagatctactgacagggggggggtctcaggaggcagcgctctcaggacgtcaccaccatggcctgggctctgctcctcctcaccctcctcactcagggcacagggtcctgggcccagtctgccctgactcagccgccctccgcgtccgggtctcctggacagtctgtcaccatctcctgcactggaaccagcagtgacgttggtgattataactatgtctcctggtaccaacagtacccaggcaaagcccccagactcatgatttatgcggtcagtaagcggccctcaggggtccctgatcgcttctctggctccaagtctggcaacacggcctccctgaccgtctctgggctccgggctgaagatgaggctgattatttntgcagctcntatgcaggcagcaacaattttgtgatacttggcggagggaccaagctgaccgtccgtaggtcacgcccaagg

SEQ ID NO: 783159 - DNA, 510 bp, Homo sapiens
  misc_feature: HIJSMM301BMS41.9.38.D05.1.454.light.4.raw
tgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagagtagcctctcgtggttttcggcgggggaccaaggtgaccgtctaatcagcccaaggctgcccctcggtcactctcgttccacctcct

SEQ ID NO: 783160 - DNA, 513 bp, Homo sapiens
  misc_feature: HIJSMM301COP57.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctcctgaccgtctctgggctccaagctgaggatgaggctgattattactgcagctcatatgcaggcagcagcaatgttacgttttcggcggagggaccaagctgaccgtccgtgggtcacgacccgaaggctcgccccctcggtcctacc

SEQ ID NO: 783161 - DNA, 516 bp, Homo sapiens
  misc_feature: HIJSMM301EZH6Q.22.36.D03.1.454.light.4.raw
acatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcacgaagtgaccgtcctcggtcagccaaggctcgccccctcggtcactctccg

SEQ ID NO: 783162 - DNA, 531 bp, Homo sapiens
  misc_feature: HIJSMM301CW11K.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctacactatgctaggttcggtttcccttctttcaaagtattagttcgggcgggagggaccgaggcgtgacccgtcctggtagtcacgtaccccgaggcctccgtccccccg

SEQ ID NO: 783163 - DNA, 495 bp, Homo sapiens
  misc_feature: HIJSMM301C7GK7.4.39.D06.1.454.light.4.raw
  modified_base (381)..(381): a, c, t, g, unknown or other
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgacccgtntctgggctccaggctgaggatgaggctgaattattatttgcagctcctatatgcaggcagttacaatgtgatattcggcggagggaccgaaactgaccgtcctaggtcagccaa

SEQ ID NO: 783164 - DNA, 497 bp, Homo sapiens
  misc_feature: HIJSMM301DD9FQ.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctcgcgtccgggtctcctggacagtcagtcaccatctcctgcactgcaaccagcagtgacgttggtggttcgaagtatgtctcctggtaccaacaacacccgacaaagcccccaaactcatcatttttgaggtcactacgcgaccctcaggggtccctgatcgcttctctggctccaagtctggcaacacggcctccctgacccgtctctgggctccaggctgaggatgaggctgattattactgcagctcatatgcaggcagcagcagtccccatgtgatcttcgggcgggggaccaagctgaccgtctaggtcagcccaaggct

SEQ ID NO: 783165 - DNA, 419 bp, Homo sapiens
  misc_feature: HIJSMM301BFB7Z.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggactgggaccaaggtcaccgtcctaggtcagcccaaggccaaccccactgtcactctcgttcccaccctcctccatactcgta

SEQ ID NO: 783166 - DNA, 514 bp, Homo sapiens
  misc_feature: HIJSMM301AKH60.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgtcagctcatatgcaggcagcagcacgtccccatgtgatcgttcgggcgggggaccaagctgaccgtcctaggtcacgcccgaaggctcgtccccccg

SEQ ID NO: 783167 - DNA, 500 bp, Homo sapiens
  misc_feature: HIJSMM301D2WXY.48.27.C05.1.454.light.4.raw
  modified_base (461)..(461): a, c, t, g, unknown or other
agtatacatacacgaccggtgctcgatttagacgcgatcgaagggtttgggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagttagcatgttagcacctacttagcctggtaccaacaaaagcctggccaggcctcccagactcctcatctatgatcgcgtctaccagggccactggcgtcccggccaggttcagtgccagtgggtctggggacagacttcactctcaccatcagcagcctagagcccgaagtattttgcggtttattactgtcagcagcgtgccactggcctctcacgttcggcggagggaccaaggtggacntcaaacgactgtggctgcaccatctgtcttcatctccgc

SEQ ID NO: 783168 - DNA, 519 bp, Homo sapiens
  misc_feature: HIJSMM301D4WCY.15.34.D01.1.454.light.4.raw
  modified_base (487)..(487): a, c, t, g, unknown or other
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgtttcgggcgggagggaccaaacgtgaccgttcctacggtcngcccaaggctcgccccctcggtccactcttcg

SEQ ID NO: 783169 - DNA, 509 bp, Homo sapiens
  misc_feature: HIJSMM301AYM77.48.37.D04.1.454.light.4.raw
  modified_base (479)..(479): a, c, t, g, unknown or other
agtatacatacacgaccggtgctcgatttagtagcatactgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatccagcagcctagacgcccgaagattttgcggtttattactgtcagcagcgtgccaactggcctctcacgttcgggcggagggaccaagggtggacatcaaacgactggnggctgcaccatctgtcttcactcttccccg

SEQ ID NO: 783170 - DNA, 493 bp, Homo sapiens
  misc_feature: HIJSMM301B9DLM.48.27.C05.1.454.light.4.raw
agtatacatacacgaccggtgctcgatttagacgcgatcgaagggtttgggggggagaagagctgctcagttaggacccagagggaaccatggaaaccccagcgcagcttctcttcctcctgctactctggctcccagataccaccggagcacttgtgttgacgcagtctccaggcaccctgtctttgtctccaggggagagacgccaccctctcctgcagggccagtcagagtgttagcggcggctccgtagcctggtaccagcagaaacgtggccaggttcccaggctcctcatctatgatgcatccagcagggccacgtggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatacaaacgaactgtggctgc

SEQ ID NO: 783171 - DNA, 485 bp, Homo sapiens
  misc_feature: HIJSMM301EUC0J.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcggtgggacatcagcagtggtagggtgggtttttcgggcgggtaaggggaccgaagcgtcgaccgtcctaagt

SEQ ID NO: 783172 - DNA, 508 bp, Homo sapiens
  misc_feature: HIJSMM301B8MRY.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcaaggtggcgtttgggtgttcggcggagggaccaaggctgacgtcg

SEQ ID NO: 783173 - DNA, 509 bp, Homo sapiens
  misc_feature: HIJSMM301ATU4F.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagccccaaactcatcatttatgatgccactaagcggccctcaggggtttctaatcgcttctctggctccaagtctggcaacacggcctccctgacaatctctgggctccaggctgaggacgaggctgatttactactgctgctcatatgcaggtcgtatctcttatgtcttcggaactgggaccaaggtcaccgtctaggtcagcccaaggcccaacccccactcgtcta

SEQ ID NO: 783174 - DNA, 498 bp, Homo sapiens
  misc_feature: HIJSMM301D9D6T.9.19.B08.1.454.light.4.raw
  modified_base (429)..(429): a, c, t, g, unknown or other
  modified_base (485)..(485): a, c, t, g, unknown or other
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtcgtggggcccccagggcagagggtcaccatctcctgcactggcagcagttccaacatcggggcaggttatgatgtccactggtaccagcagtttccaggaacagccccagggtcctcatctttggttacagtaatcggccctcaggggtccctgaccgattctctggctccaagtctgacacctcagcctccctggccatcactgggctccagactgaggatgaggctcattattactgccagtcttangacaaacgtcaagaacatttgggtgttcgggcggagggaccaagctgaccgttccncagtcagaccccg

SEQ ID NO: 783175 - DNA, 512 bp, Homo sapiens
  misc_feature: HIJSMM301A55OO.41.14.B03.1.454.light.4.raw
tctatactatcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggtagtcttcggaactgggaccaggggtcaccgtcctaggtcacgcccaaggccaaccccactgtcactctgtt

SEQ ID NO: 783176 - DNA, 516 bp, Homo sapiens
  misc_feature: HIJSMM301ESL31.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgccccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgtcggtttattactgcctgcagagtattcactggccgtggacgttcggccaagggaccgaaggtaggaaagtacaaacggaactacgttggctggccaccacttcg

SEQ ID NO: 783177 - DNA, 513 bp, Homo sapiens
  misc_feature: HIJSMM301DHA9B.11.59.F04.1.454.light.4.raw
  modified_base (447)..(447): a, c, t, g, unknown or other
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggacgtccctgactcgattctctggctccaagtctggcaacacggcctcctgaacatctctgggctccaggctgaggatgaggctgattattattgctgctcatatggaacgtacctacttcttttccncttcggaacttgggacccacggtccaccggtcctaggtccagccccgaaggcccaacccgacttcg

SEQ ID NO: 783178 - DNA, 496 bp, Homo sapiens
  misc_feature: HIJSMM301B5F83.4.22.B11.1.454.light.4.raw
agcactgtagcacgaccggtgctcgatttagacgacagctcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcagggcactgatttcacactgaaaatcagcacggtggaggctgaggatgttggggtttatttcttgcatgcaaggtacacactggccgtacacttttcggccagggggaccaagctggagatacaacgaactggtggctgcaccat

SEQ ID NO: 783179 - DNA, 483 bp, Homo sapiens
  misc_feature: HIJSMM301DQYD9.40.59.F04.1.454.light.4.raw
tctagcgactcacgaccggtgctcgatttagtacacacacttagggagttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagccgattctctggctccagttctgggaacacagccactctgaccatcagcgggacccaggctatggatgaggctgactattactgtcaggcgtgggacatcagcagtgaggtggttttcgggcggagggaccgaagctgaccgtcctaagtcagcccaac

SEQ ID NO: 783180 - DNA, 495 bp, Homo sapiens
  misc_feature: HIJSMM301EZBP2.16.86.H09.1.454.light.4.raw
  modified_base (407)..(407): a, c, t, g, unknown or other
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtnattattactgcagctcatatagaagtggcagcactctcgtattcggcggtggaccaagctgaccgtctacggtcagcccaaggctcgg

SEQ ID NO: 783181 - DNA, 446 bp, Homo sapiens
  misc_feature: HIJSMM301EQ0OT.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaaagctgaccgtcctaagtcagcccaaggctgccccctcggtcactctgttcccacccctcctccgtgtctgat

SEQ ID NO: 783182 - DNA, 493 bp, Homo sapiens
  misc_feature: HIJSMM301ALLNB.46.35.D02.1.454.light.4.raw
  modified_base (486)..(486): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtacacgtcccaagtaacttttcggccgacggggaccaagctggagatacaaacgaactagtggcngcaccat

SEQ ID NO: 783183 - DNA, 488 bp, Homo sapiens
  misc_feature: HIJSMM301A04P7.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctcccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatggttgggctctattattgcatgcagctctacaacgtcccgctcactttcggcggagggaccgaaggtcggagatcaaacgaa

SEQ ID NO: 783184 - DNA, 501 bp, Homo sapiens; identical to SEQ ID NO: 623613
  misc_feature: HIJSMM301BTIU2.17.27.C05.1.454.light.4.raw

SEQ ID NO: 783185 - DNA, 490 bp, Homo sapiens
  misc_feature: HIJSMM301D6J6P.19.83.H06.1.454.light.4.raw
  modified_base (469)..(469): a, c, t, g, unknown or other
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtgcagtggatcaggcacagattttacactgaaaatcaacagagtggaggctgaggatgttggggtttattactgcatgcaagctctacaactccctcaacgttcggcggagggaccaaggtggagatcaaacgactgngctgacaccatctgtcttcta

SEQ ID NO: 783186 - DNA, 517 bp, Homo sapiens
  misc_feature: HIJSMM301AWWT9.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgccctccctcaccatctctggactgaagactgaggacgaggctgactactactgtcagtcttatgataacaccagggtggtgttcggcggagggaccaagctggccgtcctaggtcagcccaaggctcgccccctcggtccactctcgttcccgccctcctcagtagtaca

SEQ ID NO: 783187 - DNA, 532 bp, Homo sapiens
  misc_feature: HIJSMM301AUYL5.40.23.C01.1.454.light.4.raw
tctagcgactcacgaccggtgctcgattttagtacacgtgattagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcggacccaggctatggatgaggctgactattactgtcaggcgtgggacgatcgagacgaggtaggtagggttgggtttttcggggaccggggtaggggaaccccgaaaggtccgttacggtacccggttacccgttaaaggttaccgaacggtaaccccc

SEQ ID NO: 783188 - DNA, 482 bp, Homo sapiens
  misc_feature: HIJSMM301AICJ1.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacacgttaccctccctactttcggcggagggaccgaaggtggagatacaaacgaactagtggctgcaccatctgtt

SEQ ID NO: 783189 - DNA, 493 bp, Homo sapiens
  misc_feature: HIJSMM301CJO9J.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatccaccttcggccaagggacacgactggagattaaacgaactgtggctgcacatctgtcttcattcc

SEQ ID NO: 783190 - DNA, 499 bp, Homo sapiens
  misc_feature: HIJSMM301AMOWM.22.14.B03.1.454.light.4.raw
  modified_base (476)..(476): a, c, t, g, unknown or other
  modified_base (494)..(494): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcacatcagcagcctgcaggctgaagatgtggcagtttattattgtcagcaaattattaatattcctcctcagacgttcgcgaaggaccaaggtggaaatnaaaacgaactagtgctgnaccca

SEQ ID NO: 783191 - DNA, 505 bp, Homo sapiens
  misc_feature: HIJSMM301AXSA9.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagccctccctgaccatcagtgggctccggtccgaggatgaggctgactattactgtgcatcacgggacgcaacatgggatggacaatctgagcggttgggtgttcggcggagggaccaaactgaaccgtcctaggtcagcccaa

SEQ ID NO: 783192 - DNA, 505 bp, Homo sapiens
  misc_feature: HIJSMM301B5YL3.7.31.C09.1.454.light.4.raw
cgtgtctctacacgaccggtgctcgatttagacgtctcatcaaggaaggaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaatcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcacgcccaaggctcgccccctc

SEQ ID NO: 783193 - DNA, 313 bp, Homo sapiens
  misc_feature: HIJSMM301DRDJA.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgaccctagtcctccttccaccctgtctgcatctgtaggagacagtagtcaccatcacttggccgggcctagtcagaatattaatagggtggttggccgtggtaatcagcagaaaccgagggaaacgcccgtaacggtcctgattatagtgtacgtactt

SEQ ID NO: 783194 - DNA, 516 bp, Homo sapiens
  misc_feature: HIJSMM301AHWXK.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagatttttaacactgaaaatcagcagagtgggaggctgaagggattggttgggggttttaagtttactgtcatgcaaagctactacgaacctcctgccggacttcggtcccgtcgggtaccgtaaaac

SEQ ID NO: 783195 - DNA, 504 bp, Homo sapiens
  misc_feature: HIJSMM301A4EST.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaacgtggcctcggttctaccttttggtccagggggaccaagctggtagatcaacgaactgtggctgcaccatctgtcttcatt

SEQ ID NO: 783196 - DNA, 529 bp, Homo sapiens
  misc_feature: HIJSMM301CCBOW.27.23.C01.1.454.light.4.raw
agcgtcgtctcacgaccggtgctcgatttagtacacgtgattggggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggccctcctgaccatctccgggctccagcctgaggacgaggctgattattattgtagttcatatacaaccagtgacacttgggtgttcggcggagggaccaggctgaccgtctaggtcagcccaaggcttcgccccctcggtcactctcgttcccgcccttccc

SEQ ID NO: 783197 - DNA, 505 bp, Homo sapiens
  misc_feature: HIJSMM301ALHH5.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccgagggggccgaagcctggagatacgagacgaacgtgtggctgcaccactctgtcttcatccttccccg

SEQ ID NO: 783198 - DNA, 525 bp, Homo sapiens
  misc_feature: HIJSMM301ATD2C.48.68.G02.1.454.light.4.raw
agtatacatacacgaccggtgctcgatttagtcgatagtgaagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgccgtcctaggtcagcccaaggcctcgccccctcggtcactctcgttcccgcccttccc

SEQ ID NO: 783199 - DNA, 497 bp, Homo sapiens
  misc_feature: HIJSMM301D5O0U.51.71.G05.1.454.light.4.raw
cgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgacgaccaaaggtcaccgtcctgggtcagcccaaggcccaaccccactgtcta

SEQ ID NO: 783200 - DNA, 462 bp, Homo sapiens
  misc_feature: HIJSMM301DMGYG.11.86.H09.1.454.light.4.raw
cgagagataccacgaccggtgctcgatttagtgctatagacttgggtttggggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgatttattactgtgcagcatgggatgacaccctgaatggtccttgtgtggttttcggcggagggaccagctgaccgtcctaggtcagcccaaggctcgccccctcggtcactctgttcccgccctcctcgtatctctcg

SEQ ID NO: 783201 - DNA, 544 bp, Homo sapiens
  misc_feature: HIJSMM301DA25I.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctcgaggttcaggtcaaactcagataaacgacagggctctggagtccccagccgcttctctggatccaaggatgattccgccaacgcagggatattactcatctctgggctccagtctgacgatgaggctgactattactgtttgacttggtcacaacaaacgccctgggatacgtttccggaaccttcgggaacccgacggtaccgacccgttacccttaacgggttccagacccccaagggaccccaaacccccaccttacgtccaacctcctt

SEQ ID NO: 783202 - DNA, 490 bp, Homo sapiens
  misc_feature: HIJSMM301ALRB0.14.53.E09.1.454.light.4.raw
cgtctagtaccacgaccggtgctcgatttagagagagtgtgtgggtccaggaggcagaactctggggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgtctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggcctcgccccctcggtccta

SEQ ID NO: 783203 - DNA, 519 bp, Homo sapiens
  misc_feature: HIJSMM301A2SQY.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccatgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgttagttcatatacaaccagtgacacttgggtgttcggcggagggaccaggctgaccgtcctaggtcagcccaaggctgccccctcggtcactctcgttcccg

SEQ ID NO: 783204 - DNA, 502 bp, Homo sapiens
  misc_feature: HIJSMM301D60WI.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagccccaaactcatgatttatgatgtcagtaatcggccctcaggggtttctaatcgcttctctggctccaagtctggcaacacggcctccctgaccatcactgggctccaggctgaggatgaggctgactattactgccagtcctatgacatgaggctgagtggttcgtatgtcttcgatctgggaccaaggtccacgtcctaagtcagccaaggccaaccct

SEQ ID NO: 783205 - DNA, 501 bp, Homo sapiens
  misc_feature: HIJSMM301COP8P.40.62.F07.1.454.light.4.raw
tctagcgactcacgaccggtgctcgatttagtagtcgcataaagggaaaggggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcgcctgcagtctgatgtattttgcaacttatttctgccaacagtatcatacttattctcggaccttcggccgacgggaccgagggtaggaaatacgaaacgaactaggtggcgtgcaccactctgtctt

SEQ ID NO: 783206 - DNA, 513 bp, Homo sapiens
  misc_feature: HIJSMM301AKBTT.9.12.B01.1.454.light.4.raw
  modified_base (401)..(401): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgnggctagtttattactgtcaactagttttcgtcggggccgttcggccgtaagggaccgaagggtacggtaaagtacgaaacgaaactacgtggtcgtgcaccaactctcgttc

SEQ ID NO: 783207 - DNA, 522 bp, Homo sapiens
  misc_feature: HIJSMM301BVRK8.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccgggtccctgatcgcttctctggctccatccttgggaacaaagctgccctcaccatcacgggggcccaggcagacgatgaatgtgatttatcactgcgttcctttatgtgggcgtggctagtttgggtgttcggcggagggaccaaactgaccgtcctaggtcacgcccaaggctcgccccctcggtccactcttccg

SEQ ID NO: 783208 - DNA, 475 bp, Homo sapiens
  misc_feature: HIJSMM301E15AT.48.2.A02.1.454.light.4.raw
agtatacatacacgaccggtgctcgatttagactcatctacaggggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggctgtggatctggcacagagttcactctcaccatcagccaccctgcagcctgaagattttgcgtactttatttctgtctacaagtattctaacttaccctcggacgttcggccagggaccaaagtggatgtcaaccgaactagtggc

SEQ ID NO: 783209 - DNA, 509 bp, Homo sapiens
  misc_feature: HIJSMM301AFTUB.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaagcgcctaatttataaggtttccaaccgggactctggggtcccagacagattcagcggcagtgggtcaggcactgatttcacactggaaatcagcagggtggaggctgaggatggttggggtttattactgcatgcaaactacacacggccgctcactttcggcgggagggaccgaaggtggagatacaaacgaactgtggctgcaccatctgtt

SEQ ID NO: 783210 - DNA, 509 bp, Homo sapiens
  misc_feature: HIJSMM301BWRB0.5.24.C02.1.454.light.4.raw
atcagacacgcacgaccggtgctcgatttagtacagatcgttaggggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtgttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattacttgcagctcatatgcaggcagcagcagtccccatgtgatcttcggcgggggaccaagctgaccgtcctaggtcagcccaaggctcgtccccccg

SEQ ID NO: 783211 - DNA, 504 bp, Homo sapiens
  misc_feature: HIJSMM301A7JHE.18.78.H01.1.454.light.4.raw
  modified_base (502)..(502): a, c, t, g, unknown or other
tacgagtatgcacgaccggtgctcgatttagtgtgagtagtttgggtttgggggggggtctcaggaggcagcactctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattacttgcagctcatatacaagcagcagcactcaagttctcggaactgggaccaaggtccaccgtctaggtcagcccaaggcccaacccnct

SEQ ID NO: 783212 - DNA, 517 bp, Homo sapiens
  misc_feature: HIJSMM301EIXQR.41.25.C03.1.454.light.4.raw
tctatactatcacgaccggtgctcgatttagtagtgtagatttgggtttggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctgggtccctttcggttttctggctccatcgacagtccctccaactccgcctcccttaccatatctgggctgaagagtgaggacgaggctgactacttctgtcagtcttatgatataaacaattatgtgatattggcggagggaccagggtgaccgtcctaggtcagcccaaggctcgccccctcggtcactctcgttcccgt

SEQ ID NO: 783213 - DNA, 505 bp, Homo sapiens
  misc_feature: HIJSMM301A8KPE.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggacgtcccatcaaggttcagcggcagtggatctggcacagtatttcactctcaccatcagcagcctgcagcctgaggtattttgctaacttattactgtctacaagtattactaccttaccgtgggtaccgttcggccgaacgggaaccgaaggtaggaaatacaaacgaacctaggtggtacgtcgacacctac

SEQ ID NO: 783214 - DNA, 503 bp, Homo sapiens
  misc_feature: HIJSMM301DF5B1.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcagggtttctaatcgcttctctggctccaagtctggcaacacggcctccctgaccatctctgggctccgaggctgaggacgaggctagatttattactgcagctcatatacaagcagcagcactcaagtctacggaactggaccaaggtcaccgtcctaggtcagcccaacggcccaacccca

SEQ ID NO: 783215 - DNA, 493 bp, Homo sapiens
  misc_feature: HIJSMM301BPEM5.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgagattttgcagtgtattactgtcagcagtatcataggtcaaacaccttcggccaaggacacgactggagattaaaggactagtggctgcaccatctgtcttcatccttccccg

SEQ ID NO: 783216 - DNA, 506 bp, Homo sapiens
  misc_feature: HIJSMM301CWONM.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcac

SEQ ID NO: 783217 - DNA, 478 bp, Homo sapiens
  misc_feature: HIJSMM301CLT1S.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcggcggagggaccaggctggaccgtccgt

SEQ ID NO: 783218 - DNA, 521 bp, Homo sapiens
  misc_feature: HIJSMM301CMHX4.47.85.H08.1.454.light.4.raw
agctcacgtacacgaccggtgctcgatttagtatcactcagtcggcgggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgttcgtttgggtgttcggcggagggaccaagttgaccgtcctaggtcagcccaaggctcgcccccttcggtcactctgttccccccg

SEQ ID NO: 783219 - DNA, 514 bp, Homo sapiens
  misc_feature: HIJSMM301CNBYB.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgctattcggcggagggaccaagctgaccgtcttaagtcagcccaaggctcgccccctcggtcacgtctgttcccaccctcct

SEQ ID NO: 783220 - DNA, 505 bp, Homo sapiens
  misc_feature: HIJSMM301CCE89.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaacccccactcgtcactctgttcccaccctcctcta

SEQ ID NO: 783221 - DNA, 494 bp, Homo sapiens
  misc_feature: HIJSMM301A3UVP.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggcactggcatcccaggcagattcagtggcagtgggtctgggacagacttcactctcaccatcagcagactggagcctgaagattttgctagtctattactgtcagcagtatggtcacgtcccaagtaacttttggcctaggggaccaagctggagatacaaacgaactgtggctgcaccatcttcg

SEQ ID NO: 783222 - DNA, 525 bp, Homo sapiens
  misc_feature: HIJSMM301A6A0L.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgaccccagtacccagactcactggctgtgtctctggggcgagacggccacaatcaactgcaggtccagccagaacattttcctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagttttattactgtcagcaattatttttcttattccctccgtggtacgttcggccgaagggaccgagggtagggaaatcgagtacgaaactggtggtctcgcacccgtat

SEQ ID NO: 783223 - DNA, 484 bp, Homo sapiens
  misc_feature: HIJSMM301D1GUL.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgctaacttacttttgtcaacaggctcagagtttcccgctcactttcggcggagggaccgaaggtggagatacaaacgaactgtggctgcaac

SEQ ID NO: 783224 - DNA, 513 bp, Homo sapiens
  misc_feature: HIJSMM301B4U1G.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcatttatttgggtgtttcggcggagggaccaagctgaccgtcctgcgtcagcccaaggctgccccctcggtcact

SEQ ID NO: 783225 - DNA, 520 bp, Homo sapiens
  misc_feature: HIJSMM301BKKLO.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggacctccagactgaggacgaggctgattattactgctgctcatatacaggggacagcattatttgggtgtttcgggcggagggaccaagctgaccgtcctgcgtcagcccaaggcctcgccccctcggtccacctcc

SEQ ID NO: 783226 - DNA, 485 bp, Homo sapiens
  misc_feature: HIJSMM301BXGKY.3.38.D05.1.454.light.4.raw
  modified_base (463)..(463): a, c, t, g, unknown or other
  modified_base (472)..(472): a, c, t, g, unknown or other
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactcctcaccatcaacagtctgccaacctgaagattttgcaacttactactgtcaacagagtttcactacccctctcactttcggcgggggaccgaaggtaggagancaacgaacngtggctggcacta

SEQ ID NO: 783227 - DNA, 520 bp, Homo sapiens
  misc_feature: HIJSMM301EH1BC.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaaggctgaccgtccgtaggtcacgacccaaggcctcgccccctcggtccactctcgttccccta

SEQ ID NO: 783228 - DNA, 521 bp, Homo sapiens; identical to SEQ ID NO: 539470
  misc_feature: HIJSMM301EAU0I.27.23.C01.1.454.light.4.raw

SEQ ID NO: 783229 - DNA, 495 bp, Homo sapiens
  misc_feature: HIJSMM301C2FF8.5.39.D06.1.454.light.4.raw
atcagacacgcacgaccggtgctcgatttagtgacatctcgcagttctttggggggagtcagactcagtcaggacacagcatggacatgagggtcccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccagggagaggccccaaagctccttatttatgatgcctccactttgattagtggggtcccaccaacgttcagcggcagtggatctgggacagagttcactctcaccatcagcagcctgcagcctgatgatcttggtaacttattactgtccaacaatataatagttattggacgttcggccgagggaccgaaggtcgaaagtgaagacgaactgtaggctgcacagtctcg

SEQ ID NO: 783230 - DNA, 498 bp, Homo sapiens
  misc_feature: HIJSMM301B4I4D.48.27.C05.1.454.light.4.raw
agtatacatacacgaccggtgctcgatttagacgcgatcgaagggtttgggggaagagctgctcagttaggacccagagggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaaagctggccaggctcccaggctcctcatatatgatgtttctaccagggccactggcattccagacaggttcagtggcagtgggtctgggacagacttcactctcaccatcaacagattggagcctgaagactctgcagtctatttctgtcagcaatatcgcagttcagtctcgtacacttttggcctaggggaccacgctggagatcaaacgaactgtggctgcacatctgtctt

SEQ ID NO: 783231 - DNA, 489 bp, Homo sapiens
  misc_feature: HIJSMM301AT5KZ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggaacgttcggtccaagggaccaaggtggagtaatcagagaa

SEQ ID NO: 783232 - DNA, 511 bp, Homo sapiens
  misc_feature: HIJSMM301CP2WL.43.34.D01.1.454.light.4.raw
  modified_base (428)..(428): a, c, t, g, unknown or other
  modified_base (447)..(447): a, c, t, g, unknown or other
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcactangcaggtaagttacaacttnttagtcttcggtaattgggacgtacggtcaccgtcctaggtcagacccaacggccaacccaccg

SEQ ID NO: 783233 - DNA, 517 bp, Homo sapiens
  misc_feature: HIJSMM301B6YYS.10.28.C06.1.454.light.4.raw
catagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacgacggcctccctgaccatctctgggctccagactgaggacggaggctgattattactgcagctcacatacaagcggcagcggttggtggttcgggcgggggaccacactcgaccgtcctaggtcagcccaaggctcgccccctcggtcacgtctcgtt

SEQ ID NO: 783234 - DNA, 494 bp, Homo sapiens; identical to SEQ ID NO: 534992
  misc_feature: HIJSMM301ASUT6.9.1.A01.1.454.light.4.raw

SEQ ID NO: 783235 - DNA, 349 bp, Homo sapiens; identical to SEQ ID NO: 537129
  misc_feature: HIJSMM301C8R8S.13.11.A11.1.454.light.4.raw

SEQ ID NO: 783236 - DNA, 512 bp, Homo sapiens
  misc_feature: HIJSMM301AR5YF.41.45.E01.1.454.light.4.raw
tctatactatcacgaccggtgctcgatttagtgagtcagtaagggaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttatggtaccagcagaagccagcccaggccccctgtgttggtgatgtaataaagacagtgagaggccctcgagggatccctgagcgattctctggcgccagctcaggaacagtagtcacgttgaccatcagtggagtccaggcagaagacgaggctgactattattgtcaagcagtagacagcagtggtccttagttcgggtgttcgggcgggggaccagcgtcgaccgtcctaggtcagacccaaggctcgccccctcggtcacttccg

SEQ ID NO: 783237 - DNA, 506 bp, Homo sapiens
  misc_feature: HIJSMM301EPZH3.3.33.C11.1.454.light.4.raw
  modified_base (454)..(454): a, c, t, g, unknown or other
agacgcactccacgaccggtgctcgatttagagtgagctcgttggggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacacttgttttcggnggtagggaccgaagctgaccgtcctaggtcacgcccaaggctcgtccccccg

SEQ ID NO: 783238 - DNA, 512 bp, Homo sapiens
  misc_feature: HIJSMM301AW7FX.41.14.B03.1.454.light.4.raw
  modified_base (428)..(428): a, c, t, g, unknown or other
tctatactatcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgattttatgatgtcagtaatcggccctcaggggtttctaatcgcttctctggctccaagtctggcaacacggcctccctgaccatctctgggctccaggctgaggacgaggctgattattactgcagctcatataanaagcagcagcactctcgtggtattcggcggagggaccgaagcgtagtaaccgtcctaggtcagcccgaaggctcgcccccttcc

SEQ ID NO: 783239 - DNA, 445 bp, Homo sapiens; identical to SEQ ID NO: 637571
  misc_feature: HIJSMM301DFIST.8.73.G07.1.454.light.4.raw

SEQ ID NO: 783240 - DNA, 507 bp, Homo sapiens
  misc_feature: HIJSMM301B422A.16.86.H09.1.454.light.4.raw
tgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaactcatgatttatgaggtcagtaatcggccctcaggggtttctaatcgcttctctggctccaagtctggcaacaccggcctccctgaccatctctgggctccagctgaggacgagggtgattattactgcagctcatatagaagtggacagcactctcgtattcggcggtgggaccaagctgaccgtcctaggtcagcccgaacggctcggtccccccg

SEQ ID NO: 783241 - DNA, 500 bp, Homo sapiens
  misc_feature: HIJSMM301C5ISM.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtacaaactaccttcggaccaagggacacgactggagaattaaaggaactgtggctgcaccatctgtcttcactcttccccg

SEQ ID NO: 783242 - DNA, 510 bp, Homo sapiens
  misc_feature: HIJSMM301D9RA2.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgagggacgagggctgattactactgctgctcatactgcaggtcgtatctcttatgtcttcggaactgggaccaaggtccacgtcctaggtcagcccaaggcccaacccactgtcta

SEQ ID NO: 783243 - DNA, 508 bp, Homo sapiens
  misc_feature: HIJSMM301A4I76.15.81.H04.1.454.light.4.raw
tctacgtagccacgaccggtgctcgatttagtagtgtagattcgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcgaggggtttctaatcgcttctctggctccagtctggcaacacggcctccctgaccatctctgggctccgaggcgtgaggacggagggtgtattattactgcagctcatatagaagtggcagcactctcgtattcgggcggtgggaccaagctcgacccgtcctaggtcacgcccaaggcctcgccccctc

SEQ ID NO: 783244 - DNA, 500 bp, Homo sapiens
  misc_feature: HIJSMM301D82PC.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaatttcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtccctaagtcacgccc

SEQ ID NO: 783245 - DNA, 507 bp, Homo sapiens
  misc_feature: HIJSMM301A70UI.43.66.F11.1.454.light.4.raw
tgtgagtagtcacgaccggtgctcgatttagtcacgcgagaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtggggtctgggacagacttcactctcacccgtcaagcagactgggaccctgaagattttgcagtgtattactgtcagcagtatggtagctcaccgatcaccttcggcctaagggacacgactggaggattaaccgaactgtggcgtgcaccatctgtcttcactcttcccg

SEQ ID NO: 783246 - DNA, 540 bp, Homo sapiens
  misc_feature: HIJSMM301ASBIN.48.78.H01.1.454.light.4.raw
agtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacaccaggcaaagcccccaaactcttgatttatgagatcactaagcggccctcaggcgtttctaatcgcttctctggctccaagtctggcaacacggcctccctgacaatctctgggctccaggctgaggacgaggctgatttattattgctgctcatatgcaggtggtacttacttggggttggttcggcgaggggaccggaacgacgtcgtaccggtcccgttacggtacgtacgaccgaccggacgtccgtacccccgtccccggttccg

SEQ ID NO: 783247 - DNA, 525 bp, Homo sapiens
  misc_feature: HIJSMM301EVUHU.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctcgttcccaccctt

SEQ ID NO: 783248 - DNA, 492 bp, Homo sapiens; identical to SEQ ID NO: 564633
  misc_feature: HIJSMM301ECP54.47.55.E11.1.454.light.4.raw

SEQ ID NO: 783249 - DNA, 499 bp, Homo sapiens
  misc_feature: HIJSMM301BXO0B.46.35.D02.1.454.light.4.raw
  modified_base (339)..(339): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcngtgggtctgggacagacttcactctcaccatcagcagactggagcctgaagtattttgcagtctattactgtcagcagtatggtcacggtcccaagtaacttttggccgaggggaccaagctggagatcaaacgaactagtcggctcgcgaccatcttcg

SEQ ID NO: 783250 - DNA, 522 bp, Homo sapiens
  misc_feature: HIJSMM301BJC3E.15.66.F11.1.454.light.4.raw
tctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgacccgtctctgggcctccagcctgaagatgaggctgatttatttctgcggctcatatggagacaattacagctttgtcttcgggagtgggaccgaaggtcaccgtcctaagtcagcccaacggcccaaccccacctgtcactctcgttcccctacccctccccg

SEQ ID NO: 783251 - DNA, 501 bp, Homo sapiens
  misc_feature: HIJSMM301C8T2W.43.34.D01.1.454.light.4.raw
tgtgagtagtcacgaccggtgctcgatttagatcgtctgtgttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttatgagggcactaagcggccctcgaggggtttctgatcgcttctctggctccaagtctggcaacacggcctcctgacaatctctgggctccgaggctggaggacgaggctgtatttattattgctgctcatatgcgtaggtagttactacttatgttcttacgggtaattcggggacgtacggtcaccgtcctaggtcacg

SEQ ID NO: 783252 - DNA, 527 bp, Homo sapiens
  misc_feature: HIJSMM301EWEDX.3.87.H10.1.454.light.4.raw
agacgcactccacgaccggtgctcgatttagcagtactgcgttgggtttgggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcacacggcctccctgaccatctctgggctccaggctgaggacgaggctgattatttctgcagctcatacacaaccggcaccactgtcgtggttttcggtggaggaccgaagctgaccgtcctaggtcacgcccaaggtcctcgcccccctcggtccacttccg

SEQ ID NO: 783253 - DNA, 509 bp, Homo sapiens
  misc_feature: HIJSMM301E3XXV.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaagggtcaccgtcctagggcacgtgagactcaggaaatagaccagaggggagtgaatggaggggtgcagagaactccatggctaccaggtcagcccaaggccaacccccactgtcactctgttccccgccctccctcta

SEQ ID NO: 783254 - DNA, 501 bp, Homo sapiens
  misc_feature: HIJSMM301EVWW7.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagctagagtggaggctgaggatgttggggtttattactgcatgcaagctactacaaactccttacacttttaggccagggggaccaagctggagatacaaacgaactagtggcg

SEQ ID NO: 783255 - DNA, 512 bp, Homo sapiens; identical to SEQ ID NO: 742610
  misc_feature: HIJSMM301DN3G4.16.1.A01.1.454.light.4.raw

SEQ ID NO: 783256 - DNA, 510 bp, Homo sapiens
  misc_feature: HIJSMM301CFGUM.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtcccatcgtgatcttcggcgggggaccgaagctgaccgtcctaggtcagcccaacggctcgtccccccg

SEQ ID NO: 783257 - DNA, 453 bp, Homo sapiens; identical to SEQ ID NO: 759802
  misc_feature: HIJSMM301A3I60.19.86.H09.1.454.light.4.raw

SEQ ID NO: 783258 - DNA, 512 bp, Homo sapiens
  misc_feature: HIJSMM301AQ6VR.43.67.G01.1.454.light.4.raw
tgtgagtagtcacgaccggtgctcgatttagagtatacatattgtgggcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaccagggcagcctccaaagctgctcatttacttggatctacccgggatccggggtccctgaccgattccgtggcagcgggtctgggacagacttcactctcaccatcagtagcctgcagcctgaagatgtggcaacttattacttgtcaactaatttcgttatactccgccgacgttcggtccggggaccgaccgtac

SEQ ID NO: 783259 - DNA, 504 bp, Homo sapiens
  misc_feature: HIJSMM301DGX70.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtcccctggccgattctctggctccaagtctggcgcctcagccaccctggcccatcagtgggctccggcccaggatgaggctgatttattactgtgtaggttgggatcgcagcctgactgcttacgcttcggagctgggaccaaggtcaccgtcctagggcacgtgagactcaggaaatgaccagaggggagtgaatgaggggtgcagagaactccatggctaccaggtcagcccaaggcccaacccactgtcactctgttcccaccctcctcta

SEQ ID NO: 783260 - DNA, 519 bp, Homo sapiens
  misc_feature: HIJSMM301B9QZ6.40.78.H01.1.454.light.4.raw
tctagcgactcacgaccggtgctcgatttagtgtgagtagtttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccagttacggggcccagccagaggatgagtcttattattacttgcatgctccatgtggggggtgccgtacttgggtgttcgggcggaggggaccaagctgacccgtcctac

SEQ ID NO: 783261 - DNA, 512 bp, Homo sapiens
  misc_feature: HIJSMM301D5SSQ.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttagggtccctgatcgcttctctggctccaagtctggcagaacggcctccctgaccgtctctgggctccaagctgaggatgaggctgatttattactgcagctcatatgcaggcagcagcaatgtacttttcggcggagggaccaagctcgaccgtccgtgggtcacgcccaaggctcgccccctcggtcctaccg

SEQ ID NO: 783262 - DNA, 492 bp, Homo sapiens
  misc_feature: HIJSMM301AF55B.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttattactgtcagcaatattatagtacctcctccgaggctcactttcggcggagggaccaaggtggagatacaaacgaactgt

SEQ ID NO: 783263 - DNA, 492 bp, Homo sapiens
  misc_feature: HIJSMM301BI18X.4.40.D07.1.454.light.4.raw
agcactgtagcacgaccggtgctcgatttagtgatagagcgtaacaacagagggggagctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaactaactttttagcctggtaccaacagaaagctggccaggctcccaggctcctcatctatggtgcatccatcagggcccactggcatcccagacaggttcagtggcagtgggtctgggacagacttcactctcatcatcaacagactggagcctgaggattctgcagtgtattactgtcaccagtatggtggggcgcgcgttttcggcgggggaccgaaggtggacatcaaacgacgtagtggctgcaccatctgt

SEQ ID NO: 783264 - DNA, 517 bp, Homo sapiens
  misc_feature: HIJSMM301DPQHR.40.47.E03.1.454.light.4.raw
tctagcgactcacgaccggtgctcgatttagactcgcgcacagagaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggtctgtttactactgcagctcatatgcaggcagcaataatttggtgttcggcgggggaccaagctgaccgtctaggtcacgcccaaggctcgcccccgtcggtcactcttccg

SEQ ID NO: 783265 - DNA, 495 bp, Homo sapiens
  misc_feature: HIJSMM301BFG2V.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttacggccaagggacacgactcggagattaaaggaactgtggctgcaccatctgtcttcatcttcccg

SEQ ID NO: 783266 - DNA, 501 bp, Homo sapiens
  misc_feature: HIJSMM301BPABR.43.71.G05.1.454.light.4.raw
tgtgagtagtcacgaccggtgctcgatttagtgtcgtcgcaagagagaggggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatccccagacaggttcagtggcagtgggtctgggacagacttcactctcaccgtcagcagactggaccctgaagtattttgcagtgtattactgtcagcagtatggtagctcaccgatcaccttcggccaagggacacgactggagattaaccgaactgtggctgcaccatctgtcttcta

SEQ ID NO: 783267 - DNA, 525 bp, Homo sapiens
  misc_feature: HIJSMM301ADFQ2.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtccagcccaagcctgccccctcggtccactctcgttcccgccct

SEQ ID NO: 783268 - DNA, 516 bp, Homo sapiens
  misc_feature: HIJSMM301CQNDF.17.33.C11.1.454.light.4.raw
  modified_base (444)..(444): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactcttactttggtggtgctgtgctattcggnggaggaccaagctgaccgtcttaagtcagcccaagcctgccccctggtccactctcgttcccacctccttcc

SEQ ID NO: 783269 - DNA, 532 bp, Homo sapiens
  misc_feature: HIJSMM301AQRX7.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttgggggcaaagctgccctgacactgtctggtgtgcagcctgaggacgaggctgactattactgcctactctactttggtggtgctgtgctattccgggcgggagggaccaagcctgaccgtcttaagtcacgccccaaggccttcgcccccctcggtccactctcgttccccaccctcccttaccc

SEQ ID NO: 783270 - DNA, 480 bp, Homo sapiens
  misc_feature: HIJSMM301DVGVO.48.19.B08.1.454.light.4.raw
agtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacattgggtgttcggcggagggaccaagctgaccgtctaggtcagcccaa

SEQ ID NO: 783271 - DNA, 495 bp, Homo sapiens
  misc_feature: HIJSMM301CR51L.51.29.C07.1.454.light.4.raw
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaaggaccgaaggtggaaatagaaaggaacgtgtggctgcaccatctgtc

SEQ ID NO: 783272 - DNA, 488 bp, Homo sapiens
  misc_feature: HIJSMM301EEDNU.46.26.C04.1.454.light.4.raw
actagcagtacacgaccggtgctcgatttagtctagcgactttggggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatggttgggctctattattgcatgcaagctctacaagtcccgctccactttcggcggaggacccgaaggtggagatcaaacgaa

SEQ ID NO: 783273 - DNA, 445 bp, Homo sapiens
  misc_feature: HIJSMM301CY2RA.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccaccctcctccatactcgta

SEQ ID NO: 783274 - DNA, 484 bp, Homo sapiens; identical to SEQ ID NO: 764866
  misc_feature: HIJSMM301BW4GV.47.60.F05.1.454.light.4.raw

SEQ ID NO: 783275 - DNA, 515 bp, Homo sapiens
  misc_feature: HIJSMM301DL02H.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgctactttgaagtattttgctagtctatcattgtcagcagtataattggtggtccgtcggtacggttcgtccggaacggaaccgaaggtacggaaagtaactaaacgaaacgtgtacggtctgcgaccactcttcg

SEQ ID NO: 783276 - DNA, 520 bp, Homo sapiens
  misc_feature: HIJSMM301ALWZV.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagcctagaccgtcttaagtcagcccaaggcctcgccccctcggtcacttctcgttccccaccctcc

SEQ ID NO: 783277 - DNA, 505 bp, Homo sapiens; identical to SEQ ID NO: 620894
  misc_feature: HIJSMM301C5Y8M.21.81.H04.1.454.light.4.raw

SEQ ID NO: 783278 - DNA, 509 bp, Homo sapiens
  misc_feature: HIJSMM301C0DT4.17.41.D08.1.454.light.4.raw
  modified_base (245)..(245): a, c, t, g, unknown or other
  modified_base (432)..(432): a, c, t, g, unknown or other
cgtagactagcacgaccggtgctcgatttagtcacgcgagaaagggaaaggggggaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactntttagcctggtaccaacagaagcctggccaggctcccaggctcctcatctatggtgcatccaccagggccactggcatcccagacaggttcagtggcggtgggtctgggacagaattcactctcaccatcacagtctggagcctgaagattttgctctgtatcactgtcagctaatatggtggtacnccctcactttcggcggaggggccaaggtggagatcaagcgaactgtggctgcaccatctgtcttcatccttcccgcc

SEQ ID NO: 783279 - DNA, 391 bp, Homo sapiens
  misc_feature: HIJSMM301CE9UQ.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctcgttccccaccctcctccgagcgacga

SEQ ID NO: 783280 - DNA, 506 bp, Homo sapiens
  misc_feature: HIJSMM301A8POM.4.39.D06.1.454.light.4.raw
  modified_base (448)..(448): a, c, t, g, unknown or other
  modified_base (452)..(452): a, c, t, g, unknown or other
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattatttattgcagctcatatgcaggcagttacaatgtnaatnttcgggcggagggaaccaactggaaccgtctaggtcagccaggctcgccccctc

SEQ ID NO: 783281 - DNA, 504 bp, Homo sapiens
  misc_feature: HIJSMM301DXUNK.52.78.H01.1.454.light.4.raw
cgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgctagttcggcgggagggaccaagctggaccgtcctaggtcacgcccaaggctcgccccctacggt

SEQ ID NO: 783282 - DNA, 490 bp, Homo sapiens
  misc_feature: HIJSMM301B1IR9.41.72.G06.1.454.light.4.raw
tctatactatcacgaccggtgctcgatttagctacgactgcaagggaaaggggtccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactatactgctcagcatgggacagcagcctcacaaattggatgttcggcggagggaccaagctgaccgtccaggtcagcccaac

SEQ ID NO: 783283 - DNA, 495 bp, Homo sapiens
  misc_feature: HIJSMM301BQUHH.5.28.C06.1.454.light.4.raw
  modified_base (425)..(425): a, c, t, g, unknown or other
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtaccccaaactcctgatctacgatgcatctaatttggaaataggggtctcatcaaggttcaggtgggagtggatctgggacagaattcactttcaccatcagcagcctgcaacctgaagatattgcaacatattactgtacaacagtatnatagtctcggccgtccgttcggcgggacgggaaccgaacggtaggagaatcggaacgaactaggtggctc

SEQ ID NO: 783284 - DNA, 508 bp, Homo sapiens
  misc_feature: HIJSMM301BDWQ2.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcaggcgggtctgggacagtatttcactctcaccatcagcagcctgcaggctgaagatggtggctagttttattattgtcagcaatattatattcctcctcagacgttcggaccaagggaccaaggtaggaaatacaaacgaactggtggctgccaccta

SEQ ID NO: 783285 - DNA, 523 bp, Homo sapiens
  misc_feature: HIJSMM301ASEU0.40.27.C05.1.454.light.4.raw
tctagcgactcacgaccggtgctcgatttagacgcgatcgaagggtttggggagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggatttattattgtgtgtcatgggatgacagaatgaatggtcggtgttcggcggagggaccaggctgaccgtcctaggtcagcccaaggcctcgccccctcggtccactctccg

SEQ ID NO: 783286 - DNA, 483 bp, Homo sapiens
  misc_feature: HIJSMM301AWULA.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagtattttaatttcacatcagcagcctccaacgtgatgatgttgcaacataactattgtcagcaatatgattttgctcctccgagtgcctacgttttcggcggggggtaccaagggtggaacatacaaacgaacta

SEQ ID NO: 783287 - DNA, 514 bp, Homo sapiens
  misc_feature: HIJSMM301BN3JJ.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagccccaaactcatcatttttgaggtcactacgcgaccctcaggggtccctgatcgcttctctggctccaagtctggcaacacggcctcctgaccgtctctgggctccaggctgaggatgaggctgattattactgcagctcatatgcaggcagcagcacgtccccatgtgatcgttcgggcggggggaccaaggctcgaccgtcctaggtcacgcccaacggctcgtccccccg

SEQ ID NO: 783288 - DNA, 523 bp, Homo sapiens
  misc_feature: HIJSMM301BWCYS.41.87.H10.1.454.light.4.raw
tctatactatcacgaccggtgctcgatttagcagtactgcgttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggtcactctcgttcccgt

SEQ ID NO: 783289 - DNA, 509 bp, Homo sapiens
  misc_feature: HIJSMM301AFSTD.18.78.H01.1.454.light.4.raw
  modified_base (505)..(505): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcaccagcactctctatgtcttcggaactgggaccaacggtcaccgtcctaggtcagcccaaggcccaaaccccnctgt

SEQ ID NO: 783290 - DNA, 517 bp, Homo sapiens
  misc_feature: HIJSMM301EJKWC.51.83.H06.1.454.light.4.raw
cgatcgtatacacgaccggtgctcgatttagatcacgtgcgtcgcggggggaactgctcagttaggacccagagggaaccatggaagccccagctcagcttctcttcctcctgctactctgcctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgctagtttattattgtcagcagcgaaacaactgggtcctccttcggacgtttcggccgtaacgggaccgaagggtaggaaatacaaacgaactacggtggctgcaccatctgtcttcactcttccccg

SEQ ID NO: 783291 - DNA, 509 bp, Homo sapiens
  misc_feature: HIJSMM301B6J8G.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccatttacaaaatggaagtcccatcaagattcagcggcagtggatctggcacagctttcactctcaccgtcagcagcctgcagtctgaagattttgctaacttattactgtctacaagattcttcttaccctcggacgttcgtccgacgggtaccgacggtacggagtagtcgaagaccggaacgtacgtcggcgtggaccacctactcttcg

SEQ ID NO: 783292 - DNA, 490 bp, Homo sapiens
  misc_feature: HIJSMM301BWGOD.46.35.D02.1.454.light.4.raw
actagcagtacacgaccggtgctcgatttagcacacgatagttgggtttgggggagctgctcagttaggacccagagggaaccatggaaaccccagcgcagctttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcacatcagcagactggagcctgaagattttgcagtctattactgtcagcagtatggtcacgtcccaagtaacttttggccgtaggggacctaagcgtggagatcaaacgactgtggctgcaccat

SEQ ID NO: 783293 - DNA, 515 bp, Homo sapiens
  misc_feature: HIJSMM301D9I71.40.12.B01.1.454.light.4.raw
  modified_base (494)..(494): a, c, t, g, unknown or other
tctagcgactcacgaccggtgctcgatttagtagtgtagattccgcgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggacaacaattgggtcttcggcggagggaccaagctgaccgtcctaggtcagcccaaggcncgccccctcggtcactcttcg

SEQ ID NO: 783294 - DNA, 497 bp, Homo sapiens
  misc_feature: HIJSMM301B1FHN.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggcactctccg

SEQ ID NO: 783295 - DNA, 491 bp, Homo sapiens; identical to SEQ ID NO: 592146
  misc_feature: HIJSMM301EP2J5.46.35.D02.1.454.light.4.raw

SEQ ID NO: 783296 - DNA, 537 bp, Homo sapiens
  misc_feature: HIJSMM301AV78B.15.34.D01.1.454.light.4.raw
tctacgtagccacgaccggtgctcgatttagatcgtctgtgttgggtttggggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttcccggggtccctgatcgcttctctggctccatccttgggaacaaagctgccctcaccatcacggggggccccaggcagacgatgaatgtgattatcactgcgtcctttatggtggggcgtggcatttgggtgttcggcggaggggaccaaactgacccggtcctacggtccgagcccaagggctcggtcccccctccgggtccacctcttccc

SEQ ID NO: 783297 - DNA, 501 bp, Homo sapiens
  misc_feature: HIJSMM301BFO3R.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacaggggccactggcatcccagccaggttcagtggcagtgagtctgggacagacttcactctcaccatcagcagcctagagcctgaagtattttgctactttattactgtcagcagcgtagcaactcggcctctctacgtttcggcgggagggaccgagggtaggagatcagacgaactggtggct

SEQ ID NO: 783298 - DNA, 484 bp, Homo sapiens
  misc_feature: HIJSMM301EKBIQ.49.57.F02.1.454.light.4.raw
agtcgagagacacgaccggtgctcgatttagctcgatatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtgagatacaaacg

SEQ ID NO: 783299 - DNA, 508 bp, Homo sapiens
  misc_feature: HIJSMM301AQ8P6.43.69.G03.1.454.light.4.raw
tgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcgggggaccaagctgaccgtcctaggtcagcccaacggctcgcccccgtcggtcctacc

SEQ ID NO: 783300 - DNA, 491 bp, Homo sapiens
  misc_feature: HIJSMM301EMS8H.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcaggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgccagtctgaagattgtgcaattttattactgtcagcaatataatacctggcctccgctcactttcggcggagggacccaaggttgagatacaaacgaacctgtggctgcacc

SEQ ID NO: 783301 - DNA, 504 bp, Homo sapiens
  misc_feature: HIJSMM301ADG9J.52.53.E09.1.454.light.4.raw
cgcagtacgacacgaccggtgctcgatttagagagagtgtgttggggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggaggtccgggcagaggacgaggctgactattactgtcaatcaaacagacagtagtggtacttatgtgcagttcggacggagggaccaagctgaccgtcctaggtcagcccaaggcctcggccccctcggcta

SEQ ID NO: 783302 - DNA, 499 bp, Homo sapiens
  misc_feature: HIJSMM301CCQXH.22.27.C05.1.454.light.4.raw
  modified_base (405)..(405): a, c, t, g, unknown or other
  modified_base (431)..(431): a, c, t, g, unknown or other
  modified_base (441)..(441): a, c, t, g, unknown or other
  modified_base (446)..(446): a, c, t, g, unknown or other
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtcctgaccgattcagtggcagcgggtctgggacagatttcactctcaccatcagcagcctgcaggctgaagtntgtggcagtttatactgtcagcaatnttatattccnctcanacgttcggaccaagggaccaaggtggaaatcaaacgaactggtgctgcaccta

SEQ ID NO: 783303 - DNA, 492 bp, Homo sapiens
  misc_feature: HIJSMM301AHP5A.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcgagggtacgagtgtggccttcgctcgcattcggcggagggaccgaaggtggagatacaaacgaa

SEQ ID NO: 783304 - DNA, 459 bp, Homo sapiens
  misc_feature: HIJSMM301ESZNJ.11.86.H09.1.454.light.4.raw
  modified_base (418)..(418): a, c, t, g, unknown or other
  modified_base (448)..(448): a, c, t, g, unknown or other
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggcngccccctcggtcactctgttcccacctccncgtatctctcg

SEQ ID NO: 783305 - DNA, 455 bp, Homo sapiens; identical to SEQ ID NO: 608946
  misc_feature: HIJSMM301D9X1N.19.86.H09.1.454.light.4.raw

SEQ ID NO: 783306 - DNA, 511 bp, Homo sapiens
  misc_feature: HIJSMM301D2DEQ.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcaggtgggtcaggcgctgatttcacactgagaatcagcagggtggaggctgaagatggtcggggtttattactgctatgcgagggtacaggtggtggccttcgctcgcagttcggcgggacgggaccgaaggtcggagatacaaacggaactgtggctcg

SEQ ID NO: 783307 - DNA, 482 bp, Homo sapiens
  misc_feature: HIJSMM301D6KAV.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgctaactttacttttgtcaacaggctcagacgttttcccgctcacgtttcggcggagggaccaaggtaggagatcaaacgaactgtggct

SEQ ID NO: 783308 - DNA, 522 bp, Homo sapiens
  misc_feature: HIJSMM301AWB3F.41.14.B03.1.454.light.4.raw
tctatactatcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgtcttctctggctccaagtctggcaacacggcctccctgaccatctctgggctccaggctggaggacgaggctgattattactgcagctcatatacaagcagcagctactcctcgtggtattcggcggagggaccaagcgtacgacccgtccgtacggtccaagccccaagggcctcgccccccgttcc

SEQ ID NO: 783309 - DNA, 512 bp, Homo sapiens
  misc_feature: HIJSMM301A3EFG.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctcgtcctacgtcagccaacggccaaccccactcgtcacctcttcgttcccg

SEQ ID NO: 783310 - DNA, 495 bp, Homo sapiens
  misc_feature: HIJSMM301BBU3R.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggagagtcagacgaaactgtggcgtgcaccatctgtt

SEQ ID NO: 783311 - DNA, 488 bp, Homo sapiens
  misc_feature: HIJSMM301BW5G7.46.35.D02.1.454.light.4.raw
  modified_base (463)..(463): a, c, t, g, unknown or other
actagcagtacacgaccggtgctcgatttagcacacgatagttggggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccaggggaccaagctgganatcaaacgactagtggctgcaccat

SEQ ID NO: 783312 - DNA, 489 bp, Homo sapiens
  misc_feature: HIJSMM301DSO4Y.16.86.H09.1.454.light.4.raw
tgtactactccacgaccggtgctcgatttagtgctatagacttgggtttggggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctcctgaccatctctgggctccaggctgaggacgagggtgattattactgcagctcatatagaagtggcagcactctcgtattcggcggtgggacaagctgaccgtcctaggtcagccc

SEQ ID NO: 783313 - DNA, 521 bp, Homo sapiens
  misc_feature: HIJSMM301D4GT1.18.78.H01.1.454.light.4.raw
  modified_base (228)..(228): a, c, t, g, unknown or other
tacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcngtaaagcgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctggagacgaggctgattattactgcagctcatatacaagcagcaagcactcaacgtcgttcggaacgtgggaaccaagggtccaaccgtcctaggtcagccccaaggcccaaccccactcgtcta

SEQ ID NO: 783314 - DNA, 483 bp, Homo sapiens
  misc_feature: HIJSMM301BWCA9.8.53.E09.1.454.light.4.raw
  modified_base (451)..(451): a, c, t, g, unknown or other
  modified_base (474)..(474): a, c, t, g, unknown or other
ctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtcctccagggtgaggatggaggctgattattactgccactcctatcgacaacngcctgagtatttggctgttcggnggccgggac

SEQ ID NO: 783315 - DNA, 510 bp, Homo sapiens
  misc_feature: HIJSMM301CZNUR.41.14.B03.1.454.light.4.raw
  modified_base (491)..(491): a, c, t, g, unknown or other
tctatactatcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagccccccaaactcatgatttatgatgtcagtaatcggccctcaggggtttctaatcgcttctctggctccaagtctggcaacacggcctccctgacaatctctggactccagctgaggacgaggctgattattactgctgctcatatgcaggtagtagggattgggtgttcggcggagggaccaagctgaccgtcctgggtcagcccaaggcngccccctcggtcactctcg

SEQ ID NO: 783316 - DNA, 509 bp, Homo sapiens
  misc_feature: HIJSMM301C8BO5.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcaggtgggtatgggacagacttcactctcaccatcagcagactggacgcctggagtattttgctagtttattacgtgtctagcagtatggtacttcaacaaaccttccggaccgacggggacacgacgtggagattaagcgtaactcgtggctgcaccatctagtctt

SEQ ID NO: 783317 - DNA, 494 bp, Homo sapiens
  misc_feature: HIJSMM301AQPH1.41.72.G06.1.454.light.4.raw
tctatactatcacgaccggtgctcgatttagctacgactgcaagggaaaggggctccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatggttcggcggaggaccaacgctgaccgtcctaggtcagaccccg

SEQ ID NO: 783318 - DNA, 472 bp, Homo sapiens
  misc_feature: HIJSMM301EU7V3.49.73.G07.1.454.light.4.raw
agtcgagagacacgaccggtgctcgatttagctctacgctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaaccagggaaagcccctgagctcctgatcctcgatgcatccaatttggaaacaggggtcccatcgaggttctctggaagtggctcgtgggactactattttactttcaccatccagcagactgcagcctgaagatattgcaacattattactgtcaaacagtatgataactctcccgctcactttcggcggagggaccaaggtggaagatacaaacgaa

SEQ ID NO: 783319 - DNA, 505 bp, Homo sapiens
  misc_feature: HIJSMM301EV1YT.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcgggagggaccgaggctgaccgtcctaagtcagccaaggctgcccctcggt

SEQ ID NO: 783320 - DNA, 525 bp, Homo sapiens
  misc_feature: HIJSMM301BEU6X.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattatttgtagttcatatacaaccagtgacacttgggtgttcggcggagggacccaggctgaccgtcctaggtcagcccaaggctcgccccctcggtcactctgttcccgccctt

SEQ ID NO: 783321 - DNA, 463 bp, Homo sapiens; identical to SEQ ID NO: 535062
  misc_feature: HIJSMM301BI7WI.11.73.G07.1.454.light.4.raw

SEQ ID NO: 783322 - DNA, 480 bp, Homo sapiens; identical to SEQ ID NO: 592833
  misc_feature: HIJSMM301AO0JX.7.67.G01.1.454.light.4.raw

SEQ ID NO: 783323 - DNA, 510 bp, Homo sapiens
  misc_feature: HIJSMM301BJHLD.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgctagctcatatgcaggcagttacaaatgtgatattcgggcggagggaccaaactcgaccgtcctaggtcacgcccaaggcctcgccccctc

SEQ ID NO: 783324 - DNA, 509 bp, Homo sapiens
  misc_feature: HIJSMM301BNNBY.17.87.H10.1.454.light.4.raw
cgtagactagcacgaccggtgctcgatttagcagtactgcgttgggtttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacatctctgggctccaggctgaggacgaggctgattattactgctgctcatattcaagtcgtgtcactatgtatttttggcggaggcaccaaggtgaccgtcctaggtcagcccaaggctcgccccctcggctac

SEQ ID NO: 783325 - DNA, 494 bp, Homo sapiens
  misc_feature: HIJSMM301AG4EM.4.4.A04.1.454.light.4.raw
  modified_base (487)..(487): a, c, t, g, unknown or other
agcactgtagcacgaccggtgctcgatttagagtagtgatcaggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgtcgggcaagtcagagtattaatagttggttggcctggtatcaccagagaccaggagaggccccaaggctccttatttatgatgcctccactgtgattagtggggtcccaccaacgttcagcggcagtggatctgggacatacttcactctcaccatcagcagcctgcagcctgatgatcttggaacttattactgaccaacagtataattagtttttggacgttcggccgaggggaaccgaaggtacgaaatagagacgaactagtggctgcaccactctntcttcta

SEQ ID NO: 783326 - DNA, 467 bp, Homo sapiens
  misc_feature: HIJSMM301CCPMD.13.4.A04.1.454.light.4.raw
tcacgtactacacgaccggtgctcgatttagagtagtgatcagggggcgaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagtattttactttcaccatcagcagcctgcagcctgaagatattgcaacatattactgtcagcagtatgataatctcccgatcaccttcggccaagggacacgactggagattaaacga

SEQ ID NO: 783327 - DNA, 502 bp, Homo sapiens; identical to SEQ ID NO: 654412
  misc_feature: HIJSMM301DS1OB.19.78.H01.1.454.light.4.raw

SEQ ID NO: 783328 - DNA, 500 bp, Homo sapiens
  misc_feature: HIJSMM301A8RJI.40.81.H04.1.454.light.4.raw
tctagcgactcacgaccggtgctcgatttagtagtgtagattcgcggggcacgaccggtgctcgatttagtagtgtagattcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaactctaacaaactgtgtggacggtcggccaagggacctaa

SEQ ID NO: 783329 - DNA, 465 bp, Homo sapiens
  misc_feature: HIJSMM301CN5R2.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtccgtaggtcagcccaaggctcgccccctcggtccactctcgttccccaccctcctcacgcgtatgt

SEQ ID NO: 783330 - DNA, 481 bp, Homo sapiens
  misc_feature: HIJSMM301AR45T.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcagggcgtgggacaggcaggcactcgcccgctatgtcttcggactgggaccaaggtcaccgtcctaagtcacgacccg

SEQ ID NO: 783331 - DNA, 517 bp, Homo sapiens
  misc_feature: HIJSMM301AZC84.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttataaccttgtctcctggtaccaacagcaaccaggcaaagcccccaaacttttggtttatcagggcaataagcggccctcagggtttctaatcgcttctctggctccaagtctggcaacacggccgcctgacaatctctgggctccaggctgacgacgaggctgatttttactgctgctcatatgcaggtgatcactacttttatgttcgggactgggaccaaggtcaccgtcctaggtcagcccaaggcccaaccccgactgtcgactcttccg

SEQ ID NO: 783332 - DNA, 524 bp, Homo sapiens
  misc_feature: HIJSMM301AHEG0.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctcgccccctcggtcactctgttccccgccctt

SEQ ID NO: 783333 - DNA, 526 bp, Homo sapiens
  misc_feature: HIJSMM301COQX1.5.24.C02.1.454.light.4.raw
atcagacacgcacgaccggtgctcgatttagtacagatcgttagggaaagggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcagggtccctgatcgcttctctggctccaagtctggcaacacggcctccctgaccgtctctgggctccaggctgaggatggaggctgatttattactgcagctcatatgcaggcagcagcacgtccccactagtgattccgttcgggccggggggaccaaggacctgaccgtccgtaaggtcagcccgaaggcctcgtccccccg

SEQ ID NO: 783334 - DNA, 356 bp, Homo sapiens
  misc_feature: HIJSMM301B09XG.19.22.B11.1.454.light.4.raw
tactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactccaataataagaactacttagcttggttccagcagaaaccaggacagcctcctaagatgcttcttttattgggcatctgcccgggaatccggggtccctgaccgattcagtggcagcgggtctgggacagtatttcactctcacca

SEQ ID NO: 783335 - DNA, 521 bp, Homo sapiens
  misc_feature: HIJSMM301BKHEN.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccggtcttaagtcgacgcccaaaggcctcgccccctcggtccactctcgttcccatccctt

SEQ ID NO: 783336 - DNA, 509 bp, Homo sapiens
  misc_feature: HIJSMM301C9HBK.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctggacccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcaacacggcctccctgacaatctctgggctccaggctgaggacgaggctgattactactgctgctcatatgcaggtcgtatctcttatgtcttcggaactgggaccaaaggtcaccgtcctaggtcagcccaacggccaacccccactgtcta

SEQ ID NO: 783337 - DNA, 416 bp, Homo sapiens
  misc_feature: HIJSMM301AGRE1.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccacccttctcgagtagtaca

SEQ ID NO: 783338 - DNA, 509 bp, Homo sapiens
  misc_feature: HIJSMM301EQCHY.15.1.A01.1.454.light.4.raw
tctacgtagccacgaccggtgctcgatttagacgtctcatcagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttaataacactatactattcggcggagggaccaagctgaccgtcctgcgtcagacccaaggctcgccccctcggtcacttccg

SEQ ID NO: 783339 - DNA, 494 bp, Homo sapiens
  misc_feature: HIJSMM301EVQYU.9.1.A01.1.454.light.4.raw
  modified_base (49)..(49): a, c, t, g, unknown or other
tgatacgtctcacgaccggtgctcgatttagacgtctcatcaggggganctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttggcagtgtattactgtcagcagtatcataggtcaaacaccttcgccaagggacacgactggagattaaaggaactgtggctgcaccatctgtcttcatcttccccg

SEQ ID NO: 783340 - DNA, 487 bp, Homo sapiens
  misc_feature: HIJSMM301BAHG5.51.65.F10.1.454.light.4.raw
cgatcgtatacacgaccggtgctcgatttagctacgctctaaggggctgatcaggactcctcagttcaccttctcacaatgaggctccctgctcagctcctggggctgctaatgctctgggtctctggatccagtggggatattgtgctgactcagtctccactcttcctgcccgtcacccctggagagccggcctccatctcctgcaggtctagtcagagcctccttcatagtaatgggtacaactatttggattggtacctgcagaagccagggcagtctccacagctcctgatcttttgggctctaatcgggcctccggcgtccctgacaggttcagtggcagtggatcaggcacagattttacactagaaaatcagcagagtggaggctgaggatgttggggtttattactgcatgcaagctctacaaatggtaggacagttcggaccgaagggaaccaaggtggaaatcaaacgaactgtgg

SEQ ID NO: 783341 - DNA, 500 bp, Homo sapiens
  misc_feature: HIJSMM301BFZGB.2.34.D01.1.454.light.4.raw
  modified_base (445)..(445): a, c, t, g, unknown or other
  modified_base (469)..(469): a, c, t, g, unknown or other
  modified_base (482)..(482): a, c, t, g, unknown or other
acgctcgacacacgaccggtgctcgatttagatcgtctgtgttgggtttgggggtctcaggaggcagcgctctcaggacgtcaccaccatggcctgggctctgctcctcctcaccctcctcactcagggcacagggtcctgggcccagtctgccctgactcagccccccctccgcgtccgggtctcctggacagtcagtcaccatctcctgcactggaatcagcagtgacctgagtccttataactatgtctcctggtaccaacaacacccaggcaaagccccccaaactcattatttatgaagtcactaagcggccctcaggggtccctgatcgcttctctggctccaagtctggcgagacggcctccctgaccgtctctgggctccaggctgaagatgaggctgatttattactgcagctcatatgcaggcagcaaacaatgngcattcggcggagggaccaagctnaccgtcctggtcngcccaaggctgccccctc

SEQ ID NO: 783342 - DNA, 522 bp, Homo sapiens
  misc_feature: HIJSMM301DZBW7.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcacgtctgttcccaccct

SEQ ID NO: 783343 - DNA, 488 bp, Homo sapiens
  misc_feature: HIJSMM301CIEX9.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgctagtctattactgtcagcagtatggtcacgtcccaagaacttttggcctagggaccaagctggagatacaaacgaactgtggctgcaccat

SEQ ID NO: 783344 - DNA, 505 bp, Homo sapiens
  misc_feature: HIJSMM301A431P.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaatctggcaacacggcctccctgaccgtctctggcctccagactgaggacgaggctgattattactgccactcatatagaagtagtactactcctgtggttttcggcggtagggaccaagctgaccgtctaggtcagcccaaggctgccccctcggtccactc

SEQ ID NO: 783345 - DNA, 504 bp, Homo sapiens
  misc_feature: HIJSMM301BLTC6.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcaggtgggtctggggcagacttcactctcaccatcagcagcctagagcctgaagtattttgctagtttattactgtcagcagcgtagcaactggccttcggttctacttttggccgaggggaccaagctggagatacaaacgaactgtggctgccactatctgtcttc

SEQ ID NO: 783346 - DNA, 502 bp, Homo sapiens
  misc_feature: HIJSMM301CR24H.43.15.B04.1.454.light.4.raw
tgtgagtagtcacgaccggtgctcgatttagacagtatatatccgcggggggaggaactgctcagttaggacccagacggaaccatggaagccccagcgcagcttctcttcctcctgctactctggctcccagaaaccactggagaaatagtgatgacgcagtctccagccaccctgtctttgtctccagggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgctagtttattactgtcaccagtatcataactggcctccaagggggactttcggcaggaccaggtggattcaaccgaactgtggctgcacatctgtcttcatcttccg

SEQ ID NO: 783347 - DNA, 501 bp, Homo sapiens
  misc_feature: HIJSMM301APP4J.4.27.C05.1.454.light.4.raw
  modified_base (366)..(366): a, c, t, g, unknown or other
  modified_base (427)..(427): a, c, t, g, unknown or other
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccntcagcgggacccaacttttagatgaggccgactatttctgtcacacgtgggacagtgggcnctagcgatcttcggcgggagggacaagctagaccgtccgtggtcagcccaaggctcgccccctcggtcactccg

SEQ ID NO: 783348 - DNA, 517 bp, Homo sapiens
  misc_feature: HIJSMM301DBCTA.17.33.C11.1.454.light.4.raw
  modified_base (430)..(430): a, c, t, g, unknown or other
  modified_base (466)..(466): a, c, t, g, unknown or other
cgtagactagcacgaccggtgctcgatttagagtgagctcgttgggtttagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtaacaaacaacaaacactcctggacccctgcccgattctcaggctccctccttggggcaaagctgccctgacactgtctggtgtgcagcctgaggacgaggctgactattactgcctactctactttggtggtnctgtgctagttcggcggagggaccaagctgaccgtntaagtcacgcccaaggctcgccccctcggtccactctcgtcccaccctcct

SEQ ID NO: 783349 - DNA, 506 bp, Homo sapiens
  misc_feature: HIJSMM301A3NOS.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgtttggggtttattactgcatgcaaactacacgacgccgctcactttcggcggagggaccaggtggagatcaaacgaactgtggctgcaccatctgtt

SEQ ID NO: 783350 - DNA, 520 bp, Homo sapiens
  misc_feature: HIJSMM301A3Q0E.22.30.C08.1.454.light.4.raw
acatacgcgtcacgaccggtgctcgatttagtctgacgtcaaagggaaagggggagctctgggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctagtcagcccaaggctgccccctcggtcactctgttcccaccctcctcacgtcg

SEQ ID NO: 783351 - DNA, 509 bp, Homo sapiens
  misc_feature: HIJSMM301BHMR9.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggtagggaccaagctgaccgtcctaggtcagcccaaggctcgccccctcggt

SEQ ID NO: 783352 - DNA, 479 bp, Homo sapiens
  misc_feature: HIJSMM301AF5ND.46.26.C04.1.454.light.4.raw
  modified_base (413)..(413): a, c, t, g, unknown or other
  modified_base (427)..(427): a, c, t, g, unknown or other
  modified_base (456)..(456): a, c, t, g, unknown or other
  modified_base (465)..(465): a, c, t, g, unknown or other
  modified_base (473)..(473): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacacttgaaaatcagcagagtggaggctgaggatgttgggntctattattgcatncagctctacaagtccgctcacttcgcggnggacgaggnggtagatnaacgaa

SEQ ID NO: 783353 - DNA, 499 bp, Homo sapiens
  misc_feature: HIJSMM301BM2LC.51.64.F09.1.454.light.4.raw
  modified_base (457)..(457): a, c, t, g, unknown or other
cgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggctgggacagaattcactctcaccatcagcagcctgcagtctgaagattttgctagtttattacttgtcagcagtatgataagtggacctccgtacacttttcggcgacggggaccaggcngggtagattcgaaacgaacgtaggttgggctcggcaccaact

SEQ ID NO: 783354 - DNA, 485 bp, Homo sapiens; identical to SEQ ID NO: 536576
  misc_feature: HIJSMM301B288Z.46.35.D02.1.454.light.4.raw

SEQ ID NO: 783355 - DNA, 496 bp, Homo sapiens
  misc_feature: HIJSMM301CAL21.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctgggccaggctcccaggctcctcatctatggtgcttctaccagggccactggtatccccgccaggttcagtgccagtgggtctgggacagagttcactctcaccatcagcagcctgcagtctgaagattttgctactttattactgtcagcaatataatgtactggttctcgattccacctttcggccaagggtacaccgacgttggagtattaaacgaaactcggtggcttggcacc

SEQ ID NO: 783356 - DNA, 366 bp, Homo sapiens
  misc_feature: HIJSMM301AO6LO.3.57.F02.1.454.light.4.raw
agacgcactccacgaccggtgctcgatttagctcgatatagttggggtttggggggtgtggtggtctcctactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcagggtgtgggatagccgttctgatcattgggtcttcgggcggcgggaccaagctgaccgtcctatgtcaacccaaggctggcccctcggtcactctgttcccgccctcctcgagtgcgtct

SEQ ID NO: 783357 - DNA, 534 bp, Homo sapiens
  misc_feature: HIJSMM301B53H7.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcgagtttcggttccttcttttacaagtattagtttcgggcgggacggggacccagggcttcggacccggttcctgagtcacgccccaagggcctcgtcccccccg

SEQ ID NO: 783358 - DNA, 367 bp, Homo sapiens; identical to SEQ ID NO: 603854
  misc_feature: HIJSMM301EZQ0A.41.34.D01.1.454.light.4.raw

SEQ ID NO: 783359 - DNA, 511 bp, Homo sapiens
  misc_feature: HIJSMM301DA9Q4.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagcccaccctctcctgtgcggccagtcagagcgttaggacgaacttagcctggtatcagcagaggcctggccaggctcccagacctcctcatctttggcgtcctttaacagggccagtggaatcccagccaggttcagcggcagtgggtctgggacttcgttcactctcaccatcaataacctgcaatctgacgactttgctagtttatttctgtcagcagtctgaagactggccgtttcactttcgggcggagggaccgaaggtggacctcaaacgaactgtcggctgcaccatctgtcttcatctcccgc

SEQ ID NO: 783360 - DNA, 501 bp, Homo sapiens
  misc_feature: HIJSMM301CE118.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctagaagactttggactttattactgtcagcagcgtgagttctcggcctccgctcacgtttcggcggtagggacccgaggggtggagatacaaacgaactgtggctgcaccatctgtcttcatt

SEQ ID NO: 783361 - DNA, 504 bp, Homo sapiens; identical to SEQ ID NO: 567396
  misc_feature: HIJSMM301AJ9G0.15.1.A01.1.454.light.4.raw

SEQ ID NO: 783362 - DNA, 502 bp, Homo sapiens
  misc_feature: HIJSMM301EANFY.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcacacggccacctcatcatcaccagggtcgaggccggggatgaggccgactactactgtcaggtgtgggatttcactactgatcatgtgggggtcttcggcggagggaccaagctgaccgtcctaagtcacgccgaagctccgccccgtcgtct

SEQ ID NO: 783363 - DNA, 525 bp, Homo sapiens
  misc_feature: HIJSMM301DXTMQ.49.37.D04.1.454.light.4.raw
agtcgagagacacgaccggtgctcgatttagtagcatactgttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgtaggctgattattactgcagctcatatacaaacataaacacttgggtgttcggcggcgggaccaaactgaccgtcctacgtcacgcccaaggctgccccctcggtccactctcgttccccta

SEQ ID NO: 783364 - DNA, 502 bp, Homo sapiens
  misc_feature: HIJSMM301B4HKS.52.35.D02.1.454.light.4.raw
cgcagtacgacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgttcttcggaactggcgaccaaggtcaccgtctgggtctagcccaacggccaacccactcgtcacttcc

SEQ ID NO: 783365 - DNA, 525 bp, Homo sapiens
  misc_feature: HIJSMM301ADNRA.19.71.G05.1.454.light.4.raw
  modified_base (504)..(504): a, c, t, g, unknown or other
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatcccggggtccctgaccgattcagtggcgagcgggtctgggacagatttcactctcaccatcagcagcctgcaggctgaagatgtggctagtttattattgtcaacaatattattaattacttacgtggtacgttcggccgaaggacccgaaggtacggtagtatactaagacgtaaacnggtaggcgttcggactacccg

SEQ ID NO: 783366 - DNA, 505 bp, Homo sapiens
  misc_feature: HIJSMM301BE8Y1.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattatactgcaggtcatatacaatcagcaacacttatgtcttcgggactgggaccaagatcaccgtcctacggtcagcccaacggcccaacccacctgcta

SEQ ID NO: 783367 - DNA, 521 bp, Homo sapiens
  misc_feature: HIJSMM301CGYI5.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgactacttgggtgttcggcggagggaccaggctgaccgtcctaggtcagcccaaggctgccccctcggtcactctgtcccacct

SEQ ID NO: 783368 - DNA, 508 bp, Homo sapiens
  misc_feature: HIJSMM301AEQND.13.25.C03.1.454.light.4.raw
  modified_base (479)..(479): a, c, t, g, unknown or other
tcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccagctgaggacgaggctgcctattactgctgctcatatgcaggttcttctgtggtcttcggcggagggtccaaagtgaccgtcctacggtnacgcccaaggctcgccccctcggtcacgt

SEQ ID NO: 783369 - DNA, 497 bp, Homo sapiens
  misc_feature: HIJSMM301EBRDA.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtactccccgccaggttcagtgccagtgggtctgggacagagttcactctcaccatcagcagcctgcagtctgaagtattttgctactttattactgtcagcaatataatgactggttctcgactcaccttccggccaacgggacacgactggagaattaaacgtaactgtggctgccaccatcttgtt

SEQ ID NO: 783370 - DNA, 509 bp, Homo sapiens
  misc_feature: HIJSMM301E3BYU.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgttggtatttggtggagggaccaagctgaccgtcctaggtcagcccaaggctcgccccctcggt

SEQ ID NO: 783371 - DNA, 444 bp, Homo sapiens; identical to SEQ ID NO: 712678
  misc_feature: HIJSMM301AEAXN.8.73.G07.1.454.light.4.raw
  modified_base (419)..(419): a, c, t, g, unknown or other

SEQ ID NO: 783372 - DNA, 489 bp, Homo sapiens
  misc_feature: HIJSMM301ALL28.16.86.H09.1.454.light.4.raw
  modified_base (439)..(439): a, c, t, g, unknown or other
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggnagcactctcgtattcggcggtgggaccagctgacccgtctaggtcagccc

SEQ ID NO: 783373 - DNA, 489 bp, Homo sapiens
  misc_feature: HIJSMM301AZ3VG.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccgaggggaccaagctggagatcaaacgaactggtggctgcaccat

SEQ ID NO: 783374 - DNA, 509 bp, Homo sapiens
  misc_feature: HIJSMM301BL0Q6.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctggggatgttggggtttattacttgcatgcaagctactactaaactccttactacttttcggccgaggggtaccaagctgggagatacgaacgaactaggtgcgtccg

SEQ ID NO: 783375 - DNA, 503 bp, Homo sapiens
  misc_feature: HIJSMM301BGF88.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcacgacgttcggaccaagggaccaaggtaggaaatacaaacgaactgtgctgaccactac

SEQ ID NO: 783376 - DNA, 496 bp, Homo sapiens
  misc_feature: HIJSMM301CPX77.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggctatttcggtctttcggcggagggaccaagctgaccgtcctaggtcagcccaaggctgcccctcggtcactctcgttcccgccctcctcgctacgtaga

SEQ ID NO: 783377 - DNA, 489 bp, Homo sapiens
  misc_feature: HIJSMM301B0QF9.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagccgggaccaggctatggatgaggctgtactttactgtcaggcgtggacaccacactgtggtttcggcggaggaccaagctgacgtcctaggtcagcccaaggctcgccccctcggtct

SEQ ID NO: 783378 - DNA, 531 bp, Homo sapiens
  misc_feature: HIJSMM301EO85E.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactcttactttggtggtgctgtgctagttcggcgggacgggaccgaagctcgaccgtcttaagtcacgcccgaaggcctcgccccctcggtcacgtctcgttccccaccctccttcccg

SEQ ID NO: 783379 - DNA, 515 bp, Homo sapiens
  misc_feature: HIJSMM301DPBUT.53.71.G05.1.454.light.4.raw
cgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactagttactgtcaggtgtgggtattttaatagtgatcattgggtgttcggcggagggaccaagctgaccgtcctaggtcagcccaaggctcgccccctcggtcactctgttcccccg

SEQ ID NO: 783380 - DNA, 499 bp, Homo sapiens
  misc_feature: HIJSMM301D6DWT.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgtacttttactgtcaggcgtgggacaccaacactgtggttttcggcggagggaccaagctgaccgtcctaggtcagcccaaggctcgccccctcggtcctacc

SEQ ID NO: 783381 - DNA, 502 bp, Homo sapiens
  misc_feature: HIJSMM301B04YH.51.29.C07.1.454.light.4.raw
  modified_base (198)..(198): a, c, t, g, unknown or other
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaanagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgctagtttattactgtacaacaatatagtgacaggcccgcagtggacgttcggccgaacgggaccaaggtaggaaatgaaaggaactgtggctgcaccatctagtctt

SEQ ID NO: 783382 - DNA, 475 bp, Homo sapiens
  misc_feature: HIJSMM301CFQD1.41.5.A05.1.454.light.4.raw
  modified_base (428)..(428): a, c, t, g, unknown or other
  modified_base (448)..(448): a, c, t, g, unknown or other
tctatactatcacgaccggtgctcgatttagatagatagacagggggcaggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcgaaagtggggtcccatcaagattcagagcagtggatctgggacagatttcactctcactatcaacagcctgcagcctgaagtatttgccacttactattgtcacaggctgacagtttcccttcnccttcgccaaggacacgacngacattaaacgaactgtgctgcaccta

SEQ ID NO: 783383 - DNA, 527 bp, Homo sapiens
  misc_feature: HIJSMM301AXKCA.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcataatacaaccagtagactacttgggtgttcgggcggagggaccaggctgaccgtcctaggtcagcccaaggctcgccccctcggtcactctcgttcccaccct

SEQ ID NO: 783384 - DNA, 478 bp, Homo sapiens
  misc_feature: HIJSMM301B58M7.51.44.D11.1.454.light.4.raw
cgatcgtatacacgaccggtgctcgatttagcgcagtacgaagggggagtcagtctcagtcaggacacagcatggacatgagggtccccgctcagctcctggggctcctgctactctggctccgaggtgtcagatgtgacatccagatgacccagtctccatcctccctgtctgcatctgtaggagacagagtcaccatcaattgccgggcaagtcagagcattagcaggtatttaaattggtatcagcagaaaccagggaaagcccctaaggtcctgatctatgctgcatccagtttgcaaagtggggtcccatcaaggttcagtggcagtggatctgggacggatttcactctcaccatcagcagtctgcaacttgcagattctgcaacttactattgtcaacagagtttcaattcccctcgcacgttcggccaagggaccaaggtggaaatcaaacgaactagtggctgcaccat

SEQ ID NO: 783385 - DNA, 526 bp, Homo sapiens
  misc_feature: HIJSMM301EA709.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaagggtagggcaatcaaaccgaacctagtggctggcaccatctgttcttcatcttccccg

SEQ ID NO: 783386 - DNA, 488 bp, Homo sapiens; identical to SEQ ID NO: 573804
  misc_feature: HIJSMM301CWK9N.46.35.D02.1.454.light.4.raw

SEQ ID NO: 783387 - DNA, 492 bp, Homo sapiens
  misc_feature: HIJSMM301B8V7Y.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcgagggtggaggctgaagagtggtcggggtttattactgcatgcagggtacagtgtggccttcgctcgcattcggcggagggaccgaaggtggagatcaaacgaa

SEQ ID NO: 783388 - DNA, 487 bp, Homo sapiens
  misc_feature: HIJSMM301B4DM4.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtacaatcagcagacaacagtaatacttatctttatgtcttggatcgtgggaccagggtcaccgtcctaggtcagcccaaggccaaccca

SEQ ID NO: 783389 - DNA, 507 bp, Homo sapiens
  misc_feature: HIJSMM301BN5XI.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactagtcaacagacttacaatataccgagggtacgttcggtcaagggaccaaggtaggagatcaaagaactagtggctgcaccatctgtcttcatctcccgcat

SEQ ID NO: 783390 - DNA, 507 bp, Homo sapiens
  misc_feature: HIJSMM301EI3QA.22.25.C03.1.454.light.4.raw
acatacgcgtcacgaccggtgctcgatttagtagtgtagatttgggtttggggggcaggagtcagaccccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttcagcggcagtggatcgtgggacagaattcactctcgccatcagcagcctgcagcctgatgattctgcaacttacttactgccaacagtattatagttagtcgggggacgttcggccaagggaccgaaggtaggaaatacgaaaacgtaactaggtcggctgcaccatctgtt

SEQ ID NO: 783391 - DNA, 483 bp, Homo sapiens; identical to SEQ ID NO: 538138
  misc_feature: HIJSMM301EYQNX.41.34.D01.1.454.light.4.raw

SEQ ID NO: 783392 - DNA, 535 bp, Homo sapiens
  misc_feature: HIJSMM301A04SQ.22.15.B04.1.454.light.4.raw
acatacgcgtcacgaccggtgctcgatttagacagtatatatccgcgggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgactaagtttggttcgttcgggcgggacgggaccgaaaggcctaggaacccgttccgtagggttccaacgcccgaaagggctcggccccccttcggtcctaa

SEQ ID NO: 783393 - DNA, 491 bp, Homo sapiens
  misc_feature: HIJSMM301CRUF9.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagtattttacactagaaaatcagcagaggtggaggctggaggatggttgggctctattattgcatgcaagctcacaacgtcccgctcacgtttcggcggagggaccaaggtggagatacaaacgaa

SEQ ID NO: 783394 - DNA, 505 bp, Homo sapiens
  misc_feature: HIJSMM301EA00B.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaaagcccccaaaactcatcatttatgatgtcagtaatcggcctcaggggtttctaatcgcttctctggctccaagtctggcaacacggcctccctgaccatctctgggctccaggctgatgacgaggctgattattactgcagtcatatacaatcagcaacacttaatgtcttcgggactcgggaccaagatcaaccgtcctaggtcagccaaggccaacccactgtcta

SEQ ID NO: 783395 - DNA, 496 bp, Homo sapiens
  misc_feature: HIJSMM301DHNIR.43.39.D06.1.454.light.4.raw
tgtgagtagtcacgaccggtgctcgatttagtgacatctcgcagttctttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactagtggctgcaccatctgtctt

SEQ ID NO: 783396 - DNA, 518 bp, Homo sapiens
  misc_feature: HIJSMM301AQBQS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatcctacccggcaagtccggggtccctgaccgattcagtggcagcgggtctgggacagatttcactctcaccatcagcagcctgcaggctgaagatggtggctaggttttattactgtcaactagttttctcgggcgtcgtacacggaccgaggtagaaatacaaacgaactagtaggctcgtcaccactcttacgtcttctactcttccccg

SEQ ID NO: 783397 - DNA, 485 bp, Homo sapiens
  misc_feature: HIJSMM301D07ID.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagtattttgcaacttattactgtctacaagatcacaattatctgggacgttcggccaagggaccaaggtaggaaatacaaacgaactagtggctgccacatctgtcttcta

SEQ ID NO: 783398 - DNA, 478 bp, Homo sapiens
  misc_feature: HIJSMM301C163K.19.71.G05.1.454.light.4.raw
  modified_base (474)..(474): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtgacgttgcaggaccgagtggatatcanagaa

SEQ ID NO: 783399 - DNA, 490 bp, Homo sapiens
  misc_feature: HIJSMM301AM4UN.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacgttttggccgaggggaccaagctggagatacaaacgaactgtggctgcaccat

SEQ ID NO: 783400 - DNA, 496 bp, Homo sapiens
  misc_feature: HIJSMM301CQSEG.27.78.H01.1.454.light.4.raw
  modified_base (388)..(388): a, c, t, g, unknown or other
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtccctcgaggttcagtggcagtggatctgggacacatttcaccctcaccatcaatagcctggaagctgaagntgctgcaacttatactgtcatcagagtactactttacctcaagtgatcaccttcggccaagggaccacgactggacgattaaacgaactcgtggctgcaccatctgtt

SEQ ID NO: 783401 - DNA, 521 bp, Homo sapiens
  misc_feature: HIJSMM301CK557.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacacaacacttgtgtcttcgggactgggaccgaggtcaccgtcctaagtcagcccagggccaaccccactcgtcactctcgttcccaccctcctccgacaccg

SEQ ID NO: 783402 - DNA, 487 bp, Homo sapiens
  misc_feature: HIJSMM301ALRSH.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctcgcgttggttttggtcttgttcggcgggcgggaccg

SEQ ID NO: 783403 - DNA, 518 bp, Homo sapiens
  misc_feature: HIJSMM301CD3LS.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgctagttggttcctctttacaagtatattcgggcggagggaccgagggctcgaccgtccctggagtcagcccaagggcctcgtcccccccg

SEQ ID NO: 783404 - DNA, 461 bp, Homo sapiens; identical to SEQ ID NO: 661902
  misc_feature: HIJSMM301A3AD9.22.28.C06.1.454.light.4.raw

SEQ ID NO: 783405 - DNA, 524 bp, Homo sapiens; identical to SEQ ID NO: 661781
  misc_feature: HIJSMM301EFPXS.27.23.C01.1.454.light.4.raw

SEQ ID NO: 783406 - DNA, 487 bp, Homo sapiens
  misc_feature: HIJSMM301DS29I.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaaatggagacaactatttggattggtacctgcagaagccagggcagtctccacagctcatcatctatttggttctaatcgggcctccggggtccctgacaggttcagtggcagtggatcaggcacagatttacactagaaaatcagcagagtggaggctgaggatgttgggctcgtattattgcatgcaagctctacaagtcccgctcactttcggcggagggaccaaggtcgagatcaaacgactt

SEQ ID NO: 783407 - DNA, 505 bp, Homo sapiens
  misc_feature: HIJSMM301B13QP.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctggacaccacgcctcgctgcttggcttttcggcggagggaccaagctgaccgtccgtggtcagccaaggctgccccctcggtctac

SEQ ID NO: 783408 - DNA, 503 bp, Homo sapiens
  misc_feature: HIJSMM301AZMKW.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggcccgattcagtgccagcgggtctgggacagagttcactctcaccatcagcagcctgcaggctgaagatgtggcagtttattactgtcagcaatattttcgtgctccgtactacttttggccgtagggggacccgaggtcggagatcagacgaactgtggctggcaccatctgtcttcatctcccgt

SEQ ID NO: 783409 - DNA, 511 bp, Homo sapiens
  misc_feature: HIJSMM301AJ6GW.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcagtttgggtgttcggcggagggaccaaactgaccgtcctaggtcagcccaaggctcgccccctcggtcactctgtcccacctcctcgctacgtaga

SEQ ID NO: 783410 - DNA, 527 bp, Homo sapiens
  misc_feature: HIJSMM301APO06.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccacgcctgaggacgaggctgattattattgtagttcatatacaaccagtgacacttgggtgttcgggcggagggaccaggctggaccgtcctaggtcagcccaaggctcgccccctcggtccactctcgttcccaccct

SEQ ID NO: 783411 - DNA, 506 bp, Homo sapiens
  misc_feature: HIJSMM301CV4NI.43.55.E11.1.454.light.4.raw
tgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggtccaacgggaaccaaccgtggaaagtacaaacgaacctggtggctgccaccactctagtcttcatt

SEQ ID NO: 783412 - DNA, 468 bp, Homo sapiens
  misc_feature: HIJSMM301CXCT5.3.10.A10.1.454.light.4.raw
  modified_base (412)..(412): a, c, t, g, unknown or other
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgaggaggccctcagggatccctgagcgattctctggctccagctcagggacaacagtcacgttgaccatcagtggagtccaggcagaggacgaggctgactattattgtcaatcagcaganaaccagtaatattatctttatgtcttggatcgtggaccaggtcacgtcctaggtca

SEQ ID NO: 783413 - DNA, 509 bp, Homo sapiens
  misc_feature: HIJSMM301AZ8AO.11.57.F02.1.454.light.4.raw
cgagagataccacgaccggtgctcgatttagctcgatatagttggggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcgaagcgaactgtggctgcaccatctgtcttcatcttcccgcc

SEQ ID NO: 783414 - DNA, 531 bp, Homo sapiens
  misc_feature: HIJSMM301CIB14.27.23.C01.1.454.light.4.raw
  modified_base (450)..(450): a, c, t, g, unknown or other
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggggtntttcgggcggtagggaccaggctgaccgtcctaggtacacgcccaaggctcgccccctcggtcactctcgttcccgccctt

SEQ ID NO: 783415 - DNA, 514 bp, Homo sapiens
  misc_feature: HIJSMM301ALQXG.9.71.G05.1.454.light.4.raw
tgatacgtctcacgaccggtgctcgatttagtgtcgtcgcaagagagaggggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgctagtttggttccttctttcaagattattcgggcggagggaccaggcctgacccgtcctgagtcagcccaaggctcgtccccccg

SEQ ID NO: 783416 - DNA, 497 bp, Homo sapiens
  misc_feature: HIJSMM301C47A4.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctggaggatgttggtagtttattactgcatgcaagctactacaaactcctactctactttcggcggtagggaccgaagggtggagacgtacaaacgtaact

SEQ ID NO: 783417 - DNA, 536 bp, Homo sapiens
  misc_feature: HIJSMM301D8PD3.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccagggttctgatcgcttctatggctccaagtctgcctacacggcctccctgaccatctccgggctccagcctgaggacgaggctgattattattgtagttcatatacaaccagtgatacgttgggtgttcggcggagggaccaggctcgaccgtcctaggttcacggtcccaaggcctcgccccccgttcggtcctacctcttcgttccccgccctt

SEQ ID NO: 783418 - DNA, 523 bp, Homo sapiens
  misc_feature: HIJSMM301BZQ47.17.33.C11.1.454.light.4.raw
  modified_base (466)..(466): a, c, t, g, unknown or other
  modified_base (476)..(476): a, c, t, g, unknown or other
  modified_base (501)..(501): a, c, t, g, unknown or other
cgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgcctgacactgtctggtgtgcagcctgaggacgaggctgactattactagcctactctactttggtggtgctgtgctattcggcggacgggacaagctgaccgtnttaacgtcancccgaaggcctcgccccctcggtcncttctcgttcccaccctccctt

SEQ ID NO: 783419 - DNA, 470 bp, Homo sapiens
  misc_feature: HIJSMM301AZ36W.49.37.D04.1.454.light.4.raw
  modified_base (430)..(430): a, c, t, g, unknown or other
agtcgagagacacgaccggtgctcgatttagtagcatactgttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccaggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagtacagtatcccgtanacttttggccaggggaccaggctggactatcagaacgaac

SEQ ID NO: 783420 - DNA, 529 bp, Homo sapiens
  misc_feature: HIJSMM301BJW6M.27.23.C01.1.454.light.4.raw
  modified_base (227)..(227): a, c, t, g, unknown or other
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggggtgttcggtcgggagggtacccaggctgaccgtcctaggtcagcccaaggctgccccctcggtcactctgttcccgcctccc

SEQ ID NO: 783421 - DNA, 491 bp, Homo sapiens
  misc_feature: HIJSMM301E3U39.15.28.C06.1.454.light.4.raw
tctacgtagccacgaccggtgctcgatttagagctcacgtattgggtttgggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggaagatacaaacgaactgtaggctgcaccatctgtcttcatt

SEQ ID NO: 783422 - DNA, 476 bp, Homo sapiens
  misc_feature: HIJSMM301ANEED.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtctaatcagcagacaacagtaatacttatctttatgtcttcggatctagggaccagggtcacccgtcctaggtca

SEQ ID NO: 783423 - DNA, 447 bp, Homo sapiens; identical to SEQ ID NO: 752725
  misc_feature: HIJSMM301DPCLS.18.9.A09.1.454.light.4.raw

SEQ ID NO: 783424 - DNA, 502 bp, Homo sapiens
  misc_feature: HIJSMM301AX742.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcgactgggacaaggcaccgtcctaggtcagcccaaggcccaacccactgtcta

SEQ ID NO: 783425 - DNA, 480 bp, Homo sapiens
  misc_feature: HIJSMM301AX854.13.48.E04.1.454.light.4.raw
  modified_base (404)..(404): a, c, t, g, unknown or other
  modified_base (466)..(466): a, c, t, g, unknown or other
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgagattttgcaacttnttactgtctacaagatcacaattatcctgggacgttcggtccaagggaccaaggtggaaatnaaacgaactagtgg

SEQ ID NO: 783426 - DNA, 508 bp, Homo sapiens
  misc_feature: HIJSMM301BDI4L.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattatactgcggaacatggatagcagcctgagtactgtgataatcggcggagggaccaagctcgaccgtcctagtcagccaaggctgccccctcggtcactcctgtcccta

SEQ ID NO: 783427 - DNA, 505 bp, Homo sapiens
  misc_feature: HIJSMM301D35WB.53.30.C08.1.454.light.4.raw
cgcgtatacacacgaccggtgctcgatttagtctgacgtcaaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaacggcccaaccccactcgtcactcttccg

SEQ ID NO: 783428 - DNA, 511 bp, Homo sapiens
  misc_feature: HIJSMM301EQJ90.2.76.G10.1.454.light.4.raw
  modified_base (463)..(463): a, c, t, g, unknown or other
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtccccgggcagagggtcaccatctcttgttctggaggcacctccaacatcgggcgtgataatgtgtactggtacaagcaggtcccaggaacgacccccaaactcctcatctctcacaaataatcagcggccctcaggagtccctgaccgattctctgccctccaagtccggcacctcagcctccctggccatcagtgggctccgggccgaggatgaggctgattattactgtgcaggatgggatgacaacctgggtncgttatctcttcggtacctgggaccaaggtcaccgttccttggtaccg

SEQ ID NO: 783429 - DNA, 522 bp, Homo sapiens
  misc_feature: HIJSMM301ANF8G.8.42.D09.1.454.light.4.raw
ctcgcgtgtccacgaccggtgctcgatttagacacatacgcaggggaaagggggggggtctcaggaggcagcgctctcaggacgtcaccaccatggcctgggctctactcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatggaggctgattattactgcagctcatattcaggcagcaaacagggtattcggcggagggaccaagttggaccgtcctaggtcacgcccaaggcctgccccctcggtcactctgttccccaccctcctccg

SEQ ID NO: 783430 - DNA, 518 bp, Homo sapiens
  misc_feature: HIJSMM301CY7B4.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtccaccgtcctagggcacgtgagactcaggaaatgaccagaggggagtgaatgaggggtgcagagaactccatggctaccaggtcacgacccaacggcccaacccccactcgtcactctcgttcccaccccttccctctacgtg

SEQ ID NO: 783431 - DNA, 490 bp, Homo sapiens
  misc_feature: HIJSMM301AUPV7.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactatttcgggcggagggaccaagctgaccgtcctgcgtcagcccaaggctcgccccctcggtcactctcttcccacccctcctccgctacgtaga

SEQ ID NO: 783432 - DNA, 471 bp, Homo sapiens; identical to SEQ ID NO: 537461
  misc_feature: HIJSMM301AOGCI.7.81.H04.1.454.light.4.raw

SEQ ID NO: 783433 - DNA, 481 bp, Homo sapiens
  misc_feature: HIJSMM301B4909.49.83.H06.1.454.light.4.raw
agtcgagagacacgaccggtgctcgatttagatcacgtgcgtcgcggggggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacacgccactctgaccatcagcgggactcaggctatcgatgaggctgactattactgtcaggcgtgggacagccgcactggggtattcgggcggagggaccaagctggaccgtcctgagtcagcccaaggctccg

SEQ ID NO: 783434 - DNA, 518 bp, Homo sapiens
  misc_feature: HIJSMM301A3RJW.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgctttctctggctccaagtctggcaacacggcctccctgaccatctctggactccagactgaggacgaggctgattattactgctgctcatatacaggggacagcatttatttgggtgttcggcggagggaccaagctgaccgtcctgcgtcacgcccaaggctcgccccctcggtcacttcc

SEQ ID NO: 783435 - DNA, 511 bp, Homo sapiens
  misc_feature: HIJSMM301AVWXE.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagtattttgcagtttattactgtcaacagcgtagcagcaggcctccggcgacgttcggccaagggaccaaggtggaagtcaagcgaactgtggctgcaccatctgtcttctactcttcccgcc

SEQ ID NO: 783436 - DNA, 509 bp, Homo sapiens
  misc_feature: HIJSMM301DIQWY.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctggattattattgcagctcatatgcaggcagttacaatgtgtatattcgggcggaaggaccaaactcgaccgtcctaggtcacgccaaggctcgccccctac

SEQ ID NO: 783437 - DNA, 513 bp, Homo sapiens
  misc_feature: HIJSMM301D75J1.40.47.E03.1.454.light.4.raw
tctagcgactcacgaccggtgctcgatttagactcgcgcacagagagaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcgggcggggggaccaagctgaccgtcctaggtcagcccaaggctgccccctcggtcactctcg

SEQ ID NO: 783438 - DNA, 509 bp, Homo sapiens
  misc_feature: HIJSMM301D1IEG.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtctacggtcagcccaaggctcgtccccccg

SEQ ID NO: 783439 - DNA, 441 bp, Homo sapiens; identical to SEQ ID NO: 534971
  misc_feature: HIJSMM301DERAC.11.3.A03.1.454.light.4.raw

SEQ ID NO: 783440 - DNA, 496 bp, Homo sapiens
  misc_feature: HIJSMM301EE4A3.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgctagtttattactgtcagcagtataatgactggcctccggacgttcggccaagggaccaaggtggaaatacgaacgaactgtggctgcaccatcttcg

SEQ ID NO: 783441 - DNA, 495 bp, Homo sapiens
  misc_feature: HIJSMM301DH2DK.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctcactttcgggcggagggaccaggggtggagatcagacgaaactgtggctgcaccatctgtt

SEQ ID NO: 783442 - DNA, 448 bp, Homo sapiens
  misc_feature: HIJSMM301C8UOY.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtccagcccaacggccaacccctctgtcactctgttcccaccctcctctaactcgta

SEQ ID NO: 783443 - DNA, 499 bp, Homo sapiens
  misc_feature: HIJSMM301BU5IZ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggacgggaccgaagggccggagatcgacgacgaactgtggctgcacctatctgttcttctac

SEQ ID NO: 783444 - DNA, 525 bp, Homo sapiens; identical to SEQ ID NO: 694244
  misc_feature: HIJSMM301BF3F7.27.23.C01.1.454.light.4.raw

SEQ ID NO: 783445 - DNA, 482 bp, Homo sapiens
  misc_feature: HIJSMM301AFS63.13.76.G10.1.454.light.4.raw
  modified_base (417)..(417): a, c, t, g, unknown or other
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtccccctgtgctggtcatctatcaagatgccaagcggccctcagggatccctgagcgattctctggctccaactctgggaactcagccactctgaccatcagcgggacccaggctatggatgaggctgactattactgtcaggcgtggganagcagcactcgcccgctactgtcttcggaacgtgggaccgaaggtccaccgttcctaagtcaccg

SEQ ID NO: 783446 - DNA, 509 bp, Homo sapiens
  misc_feature: HIJSMM301APVUM.15.1.A01.1.454.light.4.raw
tctacgtagccacgaccggtgctcgatttagacgtctcatcagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggacgggacaagcgtgaccgtccttggcgtcagcccaaggctcgccccctccggtacactt

SEQ ID NO: 783447 - DNA, 500 bp, Homo sapiens
  misc_feature: HIJSMM301CLYZE.53.53.E09.1.454.light.4.raw
cgcgtatacacacgaccggtgctcgatttagagagagtgtgttgggtttgggcacgaccggtgctcgatttagagtgagctcgttggggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtgccaccctgacagtcagtggggcccaggtggaggatgaagctgattactactgttactcaacagacaggagtggaaatcaatagggtattcggcggagggaaccaaac

SEQ ID NO: 783448 - DNA, 530 bp, Homo sapiens
  misc_feature: HIJSMM301ES2VY.12.71.G05.1.454.light.4.raw
  modified_base (409)..(409): a, c, t, g, unknown or other
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaagtcccccaagttaatcatttatgagggcactaagcggccctcaggagtttctgatcgcttctctggactccaaggctggcgaccgggcctccctgacaatatctgggctccaggctggaggacgaggctnattactactgctgctcatagtggaggttatagcacttgggtgttcggcgggccgggaccaaagtgaccgtcctaagtcagcccaaggctcgccccctcggtccactctcgttcccgccctt

SEQ ID NO: 783449 - DNA, 494 bp, Homo sapiens
  misc_feature: HIJSMM301AN4C4.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttgggtcccacctcggttcagtggcaacggctctgagacagtatttttctctcgtcatcactggtctacagtctgacgacggcgcaatgtacttctgtcaaacactatcgcctcctcccccctacaactttcggtacaggggaccaagttcgaacatcaatcgaactgtggctgcaccat

SEQ ID NO: 783450 - DNA, 491 bp, Homo sapiens
  misc_feature: HIJSMM301DWBOF.14.35.D02.1.454.light.4.raw
  modified_base (489)..(489): a, c, t, g, unknown or other
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatatatagtactcctacacttttggcctaggggaccaagctggagatcaacaactgtgntg

SEQ ID NO: 783451 - DNA, 409 bp, Homo sapiens
  misc_feature: HIJSMM301A5HW5.10.86.H09.1.454.light.4.raw
catagtagtgcacgaccggtgctcgatttagtgctatagacttgggtttggaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatg

SEQ ID NO: 783452 - DNA, 507 bp, Homo sapiens
  misc_feature: HIJSMM301B57V6.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcgggggaccgaagctgaccgtcctaggtcagcccaaggctcgccccctcggtcactcttccg

SEQ ID NO: 783453 - DNA, 494 bp, Homo sapiens
  misc_feature: HIJSMM301EP8BA.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggaggatacaaacgaactagt

SEQ ID NO: 783454 - DNA, 492 bp, Homo sapiens
  misc_feature: HIJSMM301A9T09.43.29.C07.1.454.light.4.raw
  modified_base (474)..(474): a, c, t, g, unknown or other
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactacctctcactttcgaggagggaccagggtggagatcaaacgaactagtggntgcaccatctgtcttcta

SEQ ID NO: 783455 - DNA, 498 bp, Homo sapiens
  misc_feature: HIJSMM301ESXAD.41.22.B11.1.454.light.4.raw
tctatactatcacgaccggtgctcgatttagacgacagctcagggggaagagctgctcagttaggacccagagggaaccatggaaaccccagcgcagcttctcttcctcctgctactctggctcccagatgccaccggagaagttgtgttgacgcagtctccggacactcttgctttgtctccaggacaaagagccaccctctcctgtacggccagtgagagtatttccagcaccttcttagcgtggtaccagcagaaacctggccaggctcccaggctcctcatctcaggtacatatgccagggccgctggcatccctgacaggttcagtggcagtgggtctgcgacagacttcactctcaccatcagtagactggagcctgaagattttgcaacatattactagtcaccagtatgcaatctcacccaggacgttcggccgaggaccgagggtaggaaatcaagtcgaaactcgtggcgtgcgaccactctgtcttt

SEQ ID NO: 783456 - DNA, 496 bp, Homo sapiens
  misc_feature: HIJSMM301CM3TN.9.1.A01.1.454.light.4.raw
  modified_base (452)..(452): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtattactgtcagcagtatcataggtcaaacaccttcggccaagggacacgactgganagttaaaggaactgtggctgcaccatctgtcttcatcttccccg

SEQ ID NO: 783457 - DNA, 512 bp, Homo sapiens
  misc_feature: HIJSMM301DWF1V.13.25.C03.1.454.light.4.raw
tcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggcgtcagggatttccactcgcttctctggctccaagtctggcaacacggcctccctgacaatctctggtctccaggctgaggacgaggcctgcctattactgcttgctcatatgcaggttcttctgtggtcttcggcggagggtccaaaggtgaccggttcctaggttcagcccaaggctgccccctcggtcactcc

SEQ ID NO: 783458 - DNA, 494 bp, Homo sapiens
  misc_feature: HIJSMM301ECFTV.43.34.D01.1.454.light.4.raw
tgtgagtagtcacgaccggtgctcgatttagatcgtctgtgttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctaatcgcttctctggctccaagtctggcaacacggcctcctgaccatctctgggctccaggctgaggacgaggctgattattactgcagctcatatacaagcagcagcacttatgtcttcggaactgggaccaaggtcaccgactaggtcagcccaaggccaa

SEQ ID NO: 783459 - DNA, 504 bp, Homo sapiens
  misc_feature: HIJSMM301DGVFA.53.21.B10.1.454.light.4.raw
cgcgtatacacacgaccggtgctcgatttagtgtcgtcgcaagagaggagggggtgtctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggcctcagggatccctgagcgattctctggctccaactctggggacacggccaccctgaccatcagcagggtcgaagccggagacgaggccgactattactgtcagtgtgggatttaatagtgatcattggtgttcggcggagggaccaagctgaccgtctaggtcagcccaaggctcgccccctcggtcactctc

SEQ ID NO: 783460 - DNA, 476 bp, Homo sapiens
  misc_feature: HIJSMM301CMA47.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcagggtcccatctcgattcagtggcagtggatctgggacagatttcactctcaccatcagcagcctgcagcctgaagatgttgactaacttattactgtacaaaagaatagcgctcgccccgctctagtttcggcggagggaaccgaaggtaggagataaccg

SEQ ID NO: 783461 - DNA, 492 bp, Homo sapiens
  misc_feature: HIJSMM301B8DLJ.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacagcccccctatacttttggccaggggaccaagctggagatcacaggaactcgtggctgcaccattccg

SEQ ID NO: 783462 - DNA, 518 bp, Homo sapiens
  misc_feature: HIJSMM301AX2OJ.22.25.C03.1.454.light.4.raw
acatacgcgtcacgaccggtgctcgatttagtagtgtagatttgggtttggggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttcagcggcagtggatctgggacagaattcactctcgccatcagcagcctgcagcctgatgattctgcaacttattactgtccaacagtattaatagttagtcgggggacggttcggtccgaacgggaccgaaaggtagggaaataccaaagaaacctagttggcgtagtccgaccactactggtt

SEQ ID NO: 783463 - DNA, 490 bp, Homo sapiens
  misc_feature: HIJSMM301CTUWS.49.83.H06.1.454.light.4.raw
  modified_base (328)..(328): a, c, t, g, unknown or other
  modified_base (457)..(457): a, c, t, g, unknown or other
agtcgagagacacgaccggtgctcgatttagatcacgtgcgtcgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcancggcagtggatctgggacagaattcactctcaccatcaacagcctgcagcctgatgatttttgctaacttattactgccaacactataatcattattctccggccactttcggccctggccgagcgtanatatacgacgaaatcgtggctgcaccatcttcg

SEQ ID NO: 783464 - DNA, 489 bp, Homo sapiens
  misc_feature: HIJSMM301AORUD.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtgggtcccatctaggttcagtggcagtggatctgggacagatttcactctcaccatcagcagtctgcaacctgaagattttgcaacttactactgtcaacagagttacggtaccccgtacacttttggccaggggaccaaactcggacatacaaacgaactgtggctgcaccatctgtt

SEQ ID NO: 783465 - DNA, 490 bp, Homo sapiens
  misc_feature: HIJSMM301ALLCQ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggaccacgactggagtattaaaggaactaggtggctcgcacctatctgtcttc

SEQ ID NO: 783466 - DNA, 496 bp, Homo sapiens
  misc_feature: HIJSMM301EZP5N.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatacagcagggtggaggcgtgaggatgttattgggctctattattgcatgcaagcaacacactggccgtactacttttaggccaggggaccaaaggctggagatcaatcgaactgt

SEQ ID NO: 783467 - DNA, 518 bp, Homo sapiens
  misc_feature: HIJSMM301ARNXC.5.39.D06.1.454.light.4.raw
atcagacacgcacgaccggtgctcgatttagtgacatctcgcagttctttggggaggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatactaatagttaactttaggtacgttacggtccgtacggggaccgaaaggtccggaaaagttagacgaacggaactaacgttggacgtgcgaccacttacg

SEQ ID NO: 783468 - DNA, 529 bp, Homo sapiens
  misc_feature: HIJSMM301DPKAZ.9.71.G05.1.454.light.4.raw
  modified_base (505)..(505): a, c, t, g, unknown or other
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatattgggcattataaccttgtctcctggtatcaacaacgcccagacaaacgcccccacactcttaatttatgaggtcactaagcggccctcagggtttctggtcgcttctctgcctcagtctggcaacacggcctccctgacaatctctgggctccagtctgacgacgaggctgattattactgcagctcatatgcagttggttcccttcttttaccaagaatacgttcggccggaggggaccaaggccttgacccggttcctgacggttcanccccaaagggcctcggtccccccc

SEQ ID NO: 783469 - DNA, 518 bp, Homo sapiens
  misc_feature: HIJSMM301EVX95.43.15.B04.1.454.light.4.raw
tgtgagtagtcacgaccggtgctcgatttagacagtatatatccgcggggggaactgctcagttaggacccagacggaaccatggaagccccagcgcagcttctcttcctcctgctactctggctcccagaaaccactggagaaatagtgatgacgcagtctccagccaccctgtctttgtctccagggggaaagagccaccctctcatgcagggccagtcagagtgttagcaccaacgtggcctggtaccagcagaaacctggccagccgtccccggctcctcatctctggtgcatcctccagggccactggttcccccagccaggttcagtggcagtgggtctgggacagagttcactctcaccatcagcagccttcagtctgaagattttgctagtttattactgtcaccagtatcataactggcctccaagggggactttcggccgaacgggaccgaaggtaggaattcaaccgaactgtggctgcaccactctgtcttcatccttcccgccta

SEQ ID NO: 783470 - DNA, 508 bp, Homo sapiens
  misc_feature: HIJSMM301B75NI.8.28.C06.1.454.light.4.raw
ctcgcgtgtccacgaccggtgctcgatttagagctcacgtattgggtttggggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggactttcgttcactctcaccatcaataacctgcaatctgacgactttgcagttttatttctgtcagcagtctgaagactggccgttcactttcggcggagggaccaaggtggacctcaaacgtaactgtggctgcaccatctgtcttcactctcccgc

SEQ ID NO: 783471 - DNA, 495 bp, Homo sapiens
  misc_feature: HIJSMM301EF25P.53.14.B03.1.454.light.4.raw
  modified_base (432)..(432): a, c, t, g, unknown or other
  modified_base (438)..(438): a, c, t, g, unknown or other
cgcgtatacacacgaccggtgctcgatttagtgtgagtagttccgcggggctggggagcctagctgtgctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacaggggagaggcccccagggatccctgagcgatactctggctccagctcagggacaacagtcacattgaccatcagtggagtccaggcagaagacgaggctgactattactgtacaatctncggacngcagtggttctcatgtggtattcggcggagggaccaagctgaccgtcctaggtcacg

SEQ ID NO: 783472 - DNA, 505 bp, Homo sapiens
  misc_feature: HIJSMM301BXMMG.40.38.D05.1.454.light.4.raw
tctagcgactcacgaccggtgctcgatttagtatctgatagttgggtttggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggaccccccggtcagagggtcaccatctcttgttctggaagcagatccaacatcggaagtaatactgtaaactggtaccagcagctcccaggaacggccccccaaactcctcatctatgataatagtcacccggccctcaggggtacctgaccgattctctggctccaagtctggcacctcagcctccctggccatcagtgggctccagtctgaggatgaggctgattatcactgtgcatcctgggatgacagcctgaatgggttgggtgttcgggcggggggccaaggctgaccgtcctaagtcagcccaac

SEQ ID NO: 783473 - DNA, 522 bp, Homo sapiens
  misc_feature: HIJSMM301B5NOQ.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaattctttcttgaatccagtttgcaaaatggtgtcccatcaaggttcagtggcagtggatctgggacacaattcactctcaccatcgctgatctgcagcctgaagtattttgcaacttactactgtcaacagtagtttcagtgtcccccggacgttcggccgacgggaccacgacgtaagaacgtagagacgaaccgtagtaggcgtgcgaccatctacgtcttcgtactcttcccgt

SEQ ID NO: 783474 - DNA, 498 bp, Homo sapiens
  misc_feature: HIJSMM301C7RIP.9.50.E06.1.454.light.4.raw
tgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtcggtccacggaccgaaagtaggacatcaagcgaactacgtggcgtgcgaccactcttcg

SEQ ID NO: 783475 - DNA, 488 bp, Homo sapiens; identical to SEQ ID NO: 537260
  misc_feature: HIJSMM301DZS7P.47.70.G04.1.454.light.4.raw

SEQ ID NO: 783476 - DNA, 514 bp, Homo sapiens; identical to SEQ ID NO: 694854
  misc_feature: HIJSMM301AUPVH.7.34.D01.1.454.light.4.raw

SEQ ID NO: 783477 - DNA, 514 bp, Homo sapiens
  misc_feature: HIJSMM301EW2WS.53.71.G05.1.454.light.4.raw
  modified_base (419)..(419): a, c, t, g, unknown or other
cgcgtatacacacgaccggtgctcgatttagtgtcgtcgcaagagagaggggggggggtctcaggaggcagcgctctggggacgtctccaccatggcctgggctctgctcctccgcacctcctcactcagggcacaggctcttgggcccagtctgccctgattcagcctccctccgtgtccgggtctcctggacagtcagtcaccatctcctgcactggaaccagcagtgatgttgggggttatgactatgtctccttataacaacaccaaccaggcacagtccaagcccatgctctacaatgtcaattctcggccctcagggggccctgatcgtctctctggctccaagtctggcaatacggcctccatgaccatctctggactccaggctgaggacgatactgatttattactcctnctcacaaacaagaagtgccaccttgggtcgttcggcggacgggaccaacctcgaccgtccttaggtcagcccaacggctcgccccctccggtcta

SEQ ID NO: 783478 - DNA, 508 bp, Homo sapiens
  misc_feature: HIJSMM301DFM0Y.17.33.C11.1.454.light.4.raw
  modified_base (475)..(475): a, c, t, g, unknown or other
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgagggcttgactattactgcctactctacttggtgtgctgtgctattcggcggagggaccaagctgaccgtcttaagtcngcccaaggctgccccctggtcactctgttccgt

SEQ ID NO: 783479 - DNA, 482 bp, Homo sapiens
  misc_feature: HIJSMM301CR67Y.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacgactgaaaatcagtagagtggaggctgaggatgttggagtttattactgcatgcaagctctacaactcctctcacttcggcggagggaccaggtggagatcaacgaact

SEQ ID NO: 783480 - DNA, 497 bp, Homo sapiens
  misc_feature: HIJSMM301AJ9BO.40.34.D01.1.454.light.4.raw
tctagcgactcacgaccggtgctcgatttagatcgtctgtgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagttcgctctcgaagtgttcggcggaggaccgagctgaccgtcctacgtcagcccaaggctccg

SEQ ID NO: 783481 - DNA, 510 bp, Homo sapiens
  misc_feature: HIJSMM301DEMY2.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaaacaatacttttgtcttcggaactgggaccaaggtcaccgtcctaggtcagcccaaggccaacccactgcactctcg

SEQ ID NO: 783482 - DNA, 488 bp, Homo sapiens; identical to SEQ ID NO: 587866
  misc_feature: HIJSMM301CO5FY.15.28.C06.1.454.light.4.raw

SEQ ID NO: 783483 - DNA, 491 bp, Homo sapiens
  misc_feature: HIJSMM301BFJV3.46.35.D02.1.454.light.4.raw
  modified_base (415)..(415): a, c, t, g, unknown or other
  modified_base (461)..(461): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgagattttgctagtctattactgtcagcngtatggtcacgtcccaagtaacttttggcaggggaccagctggagntacaaacgaactgtggctgcaccatcttcg

SEQ ID NO: 783484 - DNA, 496 bp, Homo sapiens
  misc_feature: HIJSMM301ANQK6.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttcagcggcagtggatctgggacagaattcactctcgccatcagcagcctgcagcctgatgattctgctaacttattactgccaacagtattatagttagtcggggacgttcggccaagggaccaaggtaggaaatacaaacgaactgtggctgcaccatctgtt

SEQ ID NO: 783485 - DNA, 490 bp, Homo sapiens
  misc_feature: HIJSMM301AGBGD.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtccaagtaactttggccaggggaccaagctggagagtacaaacgaactgtggctgccaccact

SEQ ID NO: 783486 - DNA, 502 bp, Homo sapiens
  misc_feature: HIJSMM301AHUKK.19.78.H01.1.454.light.4.raw
  modified_base (301)..(301): a, c, t, g, unknown or other
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgangtttccactaagcggccctcaggggtttctaatcgcttctctggctccaagtctggcaacacggcctccctgacaatctctgggctccaggctgaggacgaggctgattacctactgctgctcatatgcaggtcgtatctcttatgttcttcggaactgggaccaaggtcaccgtctaggtcagcccaaggcccaaccccc

SEQ ID NO: 783487 - DNA, 500 bp, Homo sapiens
  misc_feature: HIJSMM301CFEXC.43.33.C11.1.454.light.4.raw
tgtgagtagtcacgaccggtgctcgatttagagtgagctcgttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggttagttacacttatgtcttcggaattgggacgacggtcaccgtctaggtcacgcccaaggccaaccc

SEQ ID NO: 783488 - DNA, 421 bp, Homo sapiens
  misc_feature: HIJSMM301EQMKU.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaggtcaccgtcctgggtcagcccaaggccaaccccactgtcactctgttcccgccctcctcagacgtatca

SEQ ID NO: 783489 - DNA, 498 bp, Homo sapiens
  misc_feature: HIJSMM301CYSP3.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgagattttgcagtttatactgtcagcagcgtagcatctggcctccgtacacctttggccaggggcccaagctggagatcaaacgaactgtggctgcaccatctgtcttcatt

SEQ ID NO: 783490 - DNA, 479 bp, Homo sapiens
  misc_feature: HIJSMM301A6BAE.13.76.G10.1.454.light.4.raw
tcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagccgggacccaggctatggatgaggtctgtactattactgtcagggcggtgggacagccagcactgcccgctatgtcttcggacgtgggaccaaggtcaccgtcctagtcagccaac

SEQ ID NO: 783491 - DNA, 445 bp, Homo sapiens
  misc_feature: HIJSMM301CRWDQ.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctcgttcccacccctcctcctgtctgat

SEQ ID NO: 783492 - DNA, 490 bp, Homo sapiens; identical to SEQ ID NO: 610412
  misc_feature: HIJSMM301AI02U.22.65.F10.1.454.light.4.raw

SEQ ID NO: 783493 - DNA, 505 bp, Homo sapiens
  misc_feature: HIJSMM301AU76N.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcacgcccaacggctcgccccctcggtccact

SEQ ID NO: 783494 - DNA, 495 bp, Homo sapiens
  misc_feature: HIJSMM301AYBIR.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatcctcagagagatattctgcatccaggttcgcgaacacagcctccctgaccatcactggactcaagcctgaggacgaggctgactattactgttcagcagtgggacggcagcctcagtgaagtgggtgttcggcggacgggaccgaaactgtccgtcctacggtcgacgacccg

SEQ ID NO: 783495 - DNA, 499 bp, Homo sapiens
  misc_feature: HIJSMM301BUDMM.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactagaaaagtcagcagagtggaggctgaggatgttggggtttattacttgcatgcaagctctacaaactccttactacttttggtccaggggtaccaagctggagatacaaacgaactagt

SEQ ID NO: 783496 - DNA, 511 bp, Homo sapiens
  misc_feature: HIJSMM301EOKEW.14.85.H08.1.454.light.4.raw
  modified_base (499)..(499): a, c, t, g, unknown or other
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcggggttttcggcggagggaccaagctgaccgtcctaagtcagcccaaggctgcccccncggtcactctcg

SEQ ID NO: 783497 - DNA, 495 bp, Homo sapiens; identical to SEQ ID NO: 684541
  misc_feature: HIJSMM301ALCZE.18.59.F04.1.454.light.4.raw

SEQ ID NO: 783498 - DNA, 509 bp, Homo sapiens
  misc_feature: HIJSMM301BGK37.27.78.H01.1.454.light.4.raw
  modified_base (465)..(465): a, c, t, g, unknown or other
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactgganagttaaaacgaaacctagtcggtcgcgtcaccatacctgttccg

SEQ ID NO: 783499 - DNA, 488 bp, Homo sapiens
  misc_feature: HIJSMM301AXVS2.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgctaaacttattactgtctacaagattacaacttaccctcggacgttcggacgcgggacgaacggtaggaagtacaaacgaactacgtggc

SEQ ID NO: 783500 - DNA, 505 bp, Homo sapiens; identical to SEQ ID NO: 535987
  misc_feature: HIJSMM301B3TXN.18.37.D04.1.454.light.4.raw

SEQ ID NO: 783501 - DNA, 446 bp, Homo sapiens; identical to SEQ ID NO: 536034
  misc_feature: HIJSMM301C0XY1.18.9.A09.1.454.light.4.raw

SEQ ID NO: 783502 - DNA, 487 bp, Homo sapiens
  misc_feature: HIJSMM301D91GK.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaagggtggagatcaaacgaactgtggctgcaccat

SEQ ID NO: 783503 - DNA, 475 bp, Homo sapiens
  misc_feature: HIJSMM301BKNKT.15.81.H04.1.454.light.4.raw
  modified_base (474)..(474): a, c, t, g, unknown or other
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcagggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctcgccccctcggtcactctgttccccgccctcctcgctacgtana

SEQ ID NO: 783504 - DNA, 486 bp, Homo sapiens
  misc_feature: HIJSMM301CI6YX.41.5.A05.1.454.light.4.raw
tctatactatcacgaccggtgctcgatttagatagatagacagggggcaggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgcctacttactattgtcaacaggctgacagtttccccttctaccttcggccaagggacacgactggacaattaaacgaactgtggcttcgcaccta

SEQ ID NO: 783505 - DNA, 472 bp, Homo sapiens
  misc_feature: HIJSMM301EMKL7.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgcccccaaactcctgatttatggtgcatccatttcgcaaagtggggtcccatcaaggttcagtggcagtggatctggggcagatttcaccctcaccatcagcagtctgcaactgaagctttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 783506 - DNA, 510 bp, Homo sapiens
  misc_feature: HIJSMM301AGMIU.41.27.C05.1.454.light.4.raw
tctatactatcacgaccggtgctcgatttagacgcgatcgaagggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccacgcctgaggacggaggctgactacttactgctcagcatgggacagcacgtcctctaatggttttgggtggtttcgggtcgggaggggaccaaggctcggaccgtccgtaggtcacgaccccg

SEQ ID NO: 783507 - DNA, 513 bp, Homo sapiens
  misc_feature: HIJSMM301ASB2J.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattacttgcagctcatatgcaggcagcagcagtccccatgtgatcgttcggcggggggaccaaggctgaccgtcctacggtcacgcccaaggctgtccccccg

SEQ ID NO: 783508 - DNA, 494 bp, Homo sapiens
  misc_feature: HIJSMM301EH0LO.5.11.A11.1.454.light.4.raw
atcagacacgcacgaccggtgctcgatttagctacgactgcagggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaatcagcacggtggaggctgaggatgttggggtttatttcgtgcatgcaaggtacacactggccgtacacttttggccaggggaccaagctggagatcaaacgaactgtggctgcaccatc

SEQ ID NO: 783509 - DNA, 498 bp, Homo sapiens
  misc_feature: HIJSMM301DO0PI.3.12.B01.1.454.light.4.raw
  modified_base (424)..(424): a, c, t, g, unknown or other
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccacagggccaccggtatcccagccaggttcagtggcagtgggtctgggacagagttcactctcaccatcagcagcctgcagtctgaggtattttgctagtttattactgtcagcattacaataacngcctcggctcactttcggcggagggaccgaaggtggaggatacaaacgaactggtcgcgtcgcaccactcttcg

SEQ ID NO: 783510 - DNA, 497 bp, Homo sapiens
  misc_feature: HIJSMM301CAU3O.5.12.B01.1.454.light.4.raw
atcagacacgcacgaccggtgctcgatttagtagtgtagattccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcagggtttctgttcgcttctctggctccaagtctggcagcacggcctccctgaccatctctgggctccaggctgaggacgaggctgactattattgcagttcatatggtagtatgaagacttcttgtgtattttcggcggtagggaccaagctgaccgtcctgagtcagcccaaggctccg

SEQ ID NO: 783511 - DNA, 519 bp, Homo sapiens
  misc_feature: HIJSMM301BD6HA.19.85.H08.1.454.light.4.raw
  modified_base (321)..(321): a, c, t, g, unknown or other
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacntttcagagagattttctacctccaggacacaaaatacagcctctctgaccattactggtctccagcctgacgacgaggctgactactactgctcagcctcgggacaccagcctcgctgcttggcgttttcggcggagggaccaagctcggaccgtccggtcggtcgaccgaccgacgcctcccgtccccgtcgtccta

SEQ ID NO: 783512 - DNA, 495 bp, Homo sapiens
  misc_feature: HIJSMM301CWGKB.46.35.D02.1.454.light.4.raw
actagcagtacacgaccggtgctcgatttagcacacgatagttggggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcacttctcaccatcagcagacgtggagcctgaagtattttgctagtctattactgtcagcagtatggtcacgtcccaagtaacgtttggccgagggaccaagcgtggagatacaaacgaactgtggctgcaccat

SEQ ID NO: 783513 - DNA, 512 bp, Homo sapiens
  misc_feature: HIJSMM301C3MET.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatccggccctcaggggtttctaattcgccttctctggctccaagtctggcaacacggcctccctgaccatctctgggctccaggctgaggacgaggctgatttattactgcagctcatatacaagcagcagcactcagtctcggaactgggaccagtccaccgtctaggtcacgccaacggcccaacccactcgtctacc

SEQ ID NO: 783514 - DNA, 501 bp, Homo sapiens
  misc_feature: HIJSMM301B2D0O.43.34.D01.1.454.light.4.raw
  modified_base (428)..(428): a, c, t, g, unknown or other
  modified_base (441)..(441): a, c, t, g, unknown or other
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgaccaatctctgggctccaggctgaggacgaggctgattattattgctgctcaatntgcaggtagtacncttatgtcttcggaattgggacgacggtcaccgtcctaggtcagcccaaggccaaaccct

SEQ ID NO: 783515 - DNA, 502 bp, Homo sapiens
  misc_feature: HIJSMM301BJMD8.13.76.G10.1.454.light.4.raw
tcacgtactacacgaccggtgctcgatttagtcactcatacagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcacacgctcatctacaacacaaacactcgctcttctggggtccctcatcgcttctctggctccatccttgggaacaaagctgcccttatcatcgacgggggcccaggcagaagatgaatctgattattactgtgttctttatatgggtagtgctatttctgctgtgttcggaggaggcgacccggctcgaccggtcctcggtcacgccaaggctcgcccc

SEQ ID NO: 783516 - DNA, 517 bp, Homo sapiens
  misc_feature: HIJSMM301BCQG7.7.34.D01.1.454.light.4.raw
cgtgtctctacacgaccggtgctcgatttagatcgtctgtgttgggtttgggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacgaggggacgagcattatttgggttgttcgggcgggagggaccaagctgaccgtcctgcgtcagcccaaggctgccccctcggtcact

SEQ ID NO: 783517 - DNA, 495 bp, Homo sapiens
  misc_feature: HIJSMM301D3EHW.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtgggtcccatcaaggttcagcggcactggatctgggacagaattcactctcaccatcaacagcctgcagcctgaatgatttggcaacttactactgccaaccgtatagtacttattcggtcaccttcggccagggacacgactggagataaacgaactgtggctgcaccatcctgtcttcactt

SEQ ID NO: 783518 - DNA, 516 bp, Homo sapiens
  misc_feature: HIJSMM301CX51R.15.76.G10.1.454.light.4.raw
  modified_base (458)..(458): a, c, t, g, unknown or other
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctagttcggcggagggaccaagctgaccgtnttagtcagccaaggctcgccccctcggtccactctcgttcccaccctcctacgctacg

SEQ ID NO: 783519 - DNA, 480 bp, Homo sapiens
  misc_feature: HIJSMM301ATGI8.5.39.D06.1.454.light.4.raw
atcagacacgcacgaccggtgctcgatttagtgacatctcgcattctttggggaggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaatgtggctgcacc

SEQ ID NO: 783520 - DNA, 520 bp, Homo sapiens
  misc_feature: HIJSMM301CSCQ6.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctagttcggcggagggaccaagctgaccgtcttaagtcagcccaaggctcgccccctcggtcactctacgttcccaccctccttac

SEQ ID NO: 783521 - DNA, 487 bp, Homo sapiens; identical to SEQ ID NO: 604153
  misc_feature: HIJSMM301BWGX1.46.35.D02.1.454.light.4.raw

SEQ ID NO: 783522 - DNA, 507 bp, Homo sapiens
  misc_feature: HIJSMM301E0CG3.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggcctcaggggtccctgatcgcttctctggctccaagtctggcaacacggcctccctgacccgtctctgggctccagactgaggatgaggctgactattactgcagctcatttgcaggcagccgtatactcttcggcggagggaccaagctgaccgtcctaggtcagcccaaggcctgccccctcggtctacc

SEQ ID NO: 783523 - DNA, 529 bp, Homo sapiens
  misc_feature: HIJSMM301B3Q26.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgactacttgggtgttcggcggagggaccaggctgaccgtcctaggtcacgcccaaggctgccccctcggtcacgtcctcgttccccacccctt

SEQ ID NO: 783524 - DNA, 485 bp, Homo sapiens
  misc_feature: HIJSMM301CW9PB.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtactttattattgccaacagtataagagttaattcaactttcggcctgggaccaatgtggatatcaaacgaactgtggctagcaccatctgtt

SEQ ID NO: 783525 - DNA, 529 bp, Homo sapiens
  misc_feature: HIJSMM301AR4DH.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctcccgggctccagcctgaggacgaggctgattattattgtagttcatatacaaccagtgactacttgggtgttcggcggagggaccaggctgaccgtcctaggtcagcccaaggcctcgccccctcggtcacctctgttcccaccctcc

SEQ ID NO: 783526 - DNA, 482 bp, Homo sapiens
  misc_feature: HIJSMM301BT6QW.41.22.B11.1.454.light.4.raw
tctatactatcacgaccggtgctcgatttagacgacagctcaggggagagctgctcagttaggacccagagggaaccatggaaaccccagcgcagcttctcttcctcctgctactctggctcccagatgccaccggagaagttgtgttgacgcagtctccggacactcttgctttgtctccaggacaaagagcccaccctctcctgtacggccagtgagagttatttccagcaccttctagcgtggtaccagcagaaacctggccaggctcccaggctcctcatctcaggtacattatcgccagggccgtctggcattccctgactaggttcagttggcaggtgggtctgcgacagacttcactctcacctatcagtagacgtggagcctgaagattttgcaacatattactgtcaccagtatgacaatctccacccgacggacgttacggtccgaacgggaccgagggtaggaaagtacaa

SEQ ID NO: 783527 - DNA, 513 bp, Homo sapiens
  misc_feature: HIJSMM301CPK2E.52.78.H01.1.454.light.4.raw
cgcagtacgacacgaccggtgctcgatttagtgtgagtagtttgggtttggggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtaagtggtacttatgtgcagttcggcggtagggaaccaaggctaggaccgtcctaggtcacgcccaaggctcgccccctcggtcaccttccg

SEQ ID NO: 783528 - DNA, 490 bp, Homo sapiens
  misc_feature: HIJSMM301APMH2.51.35.D02.1.454.light.4.raw
cgatcgtatacacgaccggtgctcgatttagcacacgatagttgggtttggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctagactattattgtcaatcaacagacaccattggtattatgtcttcggaactgcgaccaaggtcaccgtcctggtcg

SEQ ID NO: 783529 - DNA, 337 bp, Homo sapiens
  misc_feature: HIJSMM301CDKP9.12.8.A08.1.454.light.4.raw
  modified_base (207)..(207): a, c, t, g, unknown or other
atacgacgtacacgaccggtgctcgatttagcatactctacaacacacgaaaggggggcaggagtcagacccagtcaggacacagcatggacatgagggtccccgctcagctcctggggctcctgctgctctggctccaggtgccgctatgcgactatcctgatgacccagtcctccctccacccgtgtctgcagcagtcggagacnggagtcaacatccacgtcggccgggccagtcaagtaagtcgttgggaggttgggttcggcctggtactcagcaagaaaccagggacacgaccctaactccttgtatttttaacgacactctgtattaagg

SEQ ID NO: 783530 - DNA, 496 bp, Homo sapiens
  misc_feature: HIJSMM301CUV3W.52.60.F05.1.454.light.4.raw
cgcagtacgacacgaccggtgctcgatttagtacgtcatcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtggttggtgatgtataaagacactgagagggccctcagggatccctgagcgattctctggctccaggtcagggacaacggtcacattggccatcagtggagtccaggcagaggacgaggctgacttattatttgtcaatcaacagacaccattggtacttatgtcttcggaactgcgaccaaggtcaccgtcctggtcagcccaaggccaaccccactgt

SEQ ID NO: 783531 - DNA, 529 bp, Homo sapiens
  misc_feature: HIJSMM301CJ6GW.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggcgggtagggaccaggctgaccgtcctaggtcagcccaaggctcgcccccgtcgtccgactctcgttcccaccctt

SEQ ID NO: 783532 - DNA, 478 bp, Homo sapiens
  misc_feature: HIJSMM301A1CJM.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaatttttttagcctggtatcagcagaaaccagggaaagttccacacctcctgatctatgctgcatccgctttgcaatcaggggtcccatctcggttcagcggcagtggatctggggacagagttcactctcaccatcagcagcctgcagcctgaagatgttgcaacttattactgtcaaaagtataacagtcgccccctttcaccttcggccaagggacacgactggagattagaacg

SEQ ID NO: 783533 - DNA, 488 bp, Homo sapiens
  misc_feature: HIJSMM301ALL8F.52.69.G03.1.454.light.4.raw
cgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaagaaccgggagagcccctaaactcctgatccatactgcatccactttgcatgctggggtcccattcaggttcggcggcagtggatctgggacagaattcactctcacaatcagcagcctgcagactgaagctccgcaatttattactgtcaacaacgtcacccgttacccgatcctaccttcggccaagggacgacggctggagattaaacgaactgtggctgccaccat

SEQ ID NO: 783534 - DNA, 495 bp, Homo sapiens
  misc_feature: HIJSMM301AN8JB.11.71.G05.1.454.light.4.raw
cgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactagtggctgcaccatactgtcttcat

SEQ ID NO: 783535 - DNA, 495 bp, Homo sapiens
  misc_feature: HIJSMM301AW4O1.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagatcatcatctattgtaatttcggtggtagggaccgaaggtggaggtcaaacgaactgtggctgcaccatctgtcttcattcc

SEQ ID NO: 783536 - DNA, 490 bp, Homo sapiens
  misc_feature: HIJSMM301DWJJY.46.35.D02.1.454.light.4.raw
actagcagtacacgaccggtgctcgatttagcacacgatagttgggtttggggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtcccaagaactttcggcctaggggaccaagctggagatcaaacgaactgtggctcgcaccat

SEQ ID NO: 783537 - DNA, 462 bp, Homo sapiens
  misc_feature: HIJSMM301BGXAV.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgttgcagcatgggattacaacctgagtgaatcctagttgggtgttcggcggagggaccaggctgaccgtcctaggtcagcccaaggctgcccctcggtcactctgttccccgccctcctcacgcgtatgt

SEQ ID NO: 783538 - DNA, 514 bp, Homo sapiens; identical to SEQ ID NO: 616165
  misc_feature: HIJSMM301AMNIZ.14.78.H01.1.454.light.4.raw

SEQ ID NO: 783539 - DNA, 528 bp, Homo sapiens
  misc_feature: HIJSMM301BGGHY.41.30.C08.1.454.light.4.raw
tctatactatcacgaccggtgctcgatttagtctgacgtcaaagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttacggactgggaccagggtcaccgtcctaggtcctaggacccaacggccctaaacccccgactacgtcactcttcccg

SEQ ID NO: 783540 - DNA, 505 bp, Homo sapiens
  misc_feature: HIJSMM301BM0LM.19.78.H01.1.454.light.4.raw
  modified_base (444)..(444): a, c, t, g, unknown or other
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaaataaagcccccaaactcatcatttatgatgccactaagcggcctcaggggtttctaatcgcttctctggctccaagtctggcaacacggcctccctgacaatctctgggctccaggctgaggacgaggctgattactactgctgctcatatgcaggtcgtatcttcttatntcttcggaaacctgggaccaaggtcaccgtcctaggtcagcccaaggccaacccactgcta

SEQ ID NO: 783541 - DNA, 511 bp, Homo sapiens
  misc_feature: HIJSMM301ANLN4.5.58.F03.1.454.light.4.raw
  modified_base (434)..(434): a, c, t, g, unknown or other
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtnatcacacttttatgttcgggactgggaccaaggtcaccgtcctaggtcagcccaaggccaacccactgtcactctcg

SEQ ID NO: 783542 - DNA, 524 bp, Homo sapiens
  misc_feature: HIJSMM301B0E06.43.34.D01.1.454.light.4.raw
  modified_base (364)..(364): a, c, t, g, unknown or other
tgtgagtagtcacgaccggtgctcgatttagatcgtctgtgttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttgggagttatagccttgtctcctggtaccaagtgcacccaggcaaagcccccaaactcatgatttatgagggcactaagcggccctcaggggtttctgatcgcttctctggctccaagtctggcaacncggcctcctgacaatctctgggctccaggctggaggacgaggctgattattattgctgctcattatgctaggtagtttacaacttagtgttacttcggaaattggggaccgtaacggtcaccgtcctagggtccacgaccccaaggcccaaaccccctac

SEQ ID NO: 783543 - DNA, 511 bp, Homo sapiens
  misc_feature: HIJSMM301DULC3.53.49.E05.1.454.light.4.raw
cgcgtatacacacgaccggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcattcgggcgggagggaccaaagctggaccgtcctgggtcagcccgaaggctcgccccctcggtcacttc

SEQ ID NO: 783544 - DNA, 523 bp, Homo sapiens
  misc_feature: HIJSMM301DFLXF.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggactgaccgtcctaggtcagccaaggctcgcccctcggtcactctcgttcccaccct

SEQ ID NO: 783545 - DNA, 521 bp, Homo sapiens
  misc_feature: HIJSMM301BDLNU.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactccatatagaagtagtactactcctgtggttttcgggcggagggaccaagctgaccgtcctaggtcacgcccaaggctcgcccccctccggtcctacctctcgttt

SEQ ID NO: 783546 - DNA, 532 bp, Homo sapiens
  misc_feature: HIJSMM301BZ4W9.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggccccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgactacttgggtggtttcgggcgggaggggaccaggcgtgaccgttcctaggtcacgccaaggctcgccccctcggtccactctgttccccaccct

SEQ ID NO: 783547 - DNA, 504 bp, Homo sapiens
  misc_feature: HIJSMM301DN35Y.22.14.B03.1.454.light.4.raw
  modified_base (406)..(406): a, c, t, g, unknown or other
  modified_base (409)..(409): a, c, t, g, unknown or other
  modified_base (490)..(490): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagtctccaccaataagagttacttagcttggttccagcagaaaccaggacatcgtcctgcactgctcatttactgggcgtctacccgggaatcccggggtccctgaccgattcagtggcagcgggtctgggacagatttcactctcaccatcagcagcctgcaggctgaagntgngcagtttatattgtcagcaatattatacttcctcctcagacgttcggaccaagggaccaaggtggaaatcaaaacgactgnggactgccactacg

SEQ ID NO: 783548 - DNA, 522 bp, Homo sapiens
  misc_feature: HIJSMM301CGD24.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggaccctgcccgattctcaggctccctccttgggggcaaagctgccctgacactgtctggtgtgcagcctggaggacggaggctgacttattactgcctactctactttggtggtgctgtgctattcggcggagggaccaagctgaccgtcttagtcagccaaggctcgccccctcggtccactctcgttaccccaccctccttcc

SEQ ID NO: 783549 - DNA, 507 bp, Homo sapiens
  misc_feature: HIJSMM301CVXGG.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcgggtggagggaccaaggtcgaccgtcctaggtcagcccaaggctcgccccccg

SEQ ID NO: 783550 - DNA, 521 bp, Homo sapiens
  misc_feature: HIJSMM301AD7E3.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttacatatctgggctgaagagtgaggacgaggctgactacttctgtcagtcttatgatataaacaattatgtgataattggcggagggaccagggtgaccgtccgtaggtcagcccaaggctcgccccctcggtcactctcgttcccgt

SEQ ID NO: 783551 - DNA, 497 bp, Homo sapiens
  misc_feature: HIJSMM301E37DB.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaactccggggtccctgaccgattcagtggcagcgggtctgggacagatttcactctcaccatcagcagcctgcaggctgaagatgtggctagttttattattgtacaacaattattattatacttcgtggacgttcggtccaacgggaccaaggtaggatatcagacgaactg

SEQ ID NO: 783552 - DNA, 534 bp, Homo sapiens
  misc_feature: HIJSMM301EOSWE.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactccatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctagttcggcggagggaccaagctagaccgttcttaagtccagccccaaggcctcgccccccttcggccactcctcgttcccctacccctccttcccg

SEQ ID NO: 783553 - DNA, 337 bp, Homo sapiens
  misc_feature: HIJSMM301A43DR.8.34.D01.1.454.light.4.raw
ctcgcgtgtccacgaccggtgctcgatttagatcgtctgtgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgctagtttatactgtcaacatcgtaccgagtggcctccgggggccactttcggccctgggaccaaagtggatatcaaacgaactgtggctgcaccatctgtcttcatcttcccgccatctgagacacgcgag

SEQ ID NO: 783554 - DNA, 497 bp, Homo sapiens
  misc_feature: HIJSMM301EMYVP.16.6.A06.1.454.light.4.raw
  modified_base (490)..(490): a, c, t, g, unknown or other
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtgcagcgggtctgggacagatttcactctcaccatcagcagcctgcaggttgaagatgtggctagtttattactgtcagcagttattatactactcctactgacgttcggcaagggaccaagggtcgagatacaaacgaactagtgcngcaccat

SEQ ID NO: 783555 - DNA, 506 bp, Homo sapiens
  misc_feature: HIJSMM301CV1H1.5.86.H09.1.454.light.4.raw
  modified_base (104)..(104): a, c, t, g, unknown or other
atcagacacgcacgaccggtgctcgatttagtgctatagacttgggtttggggggggtctcaggaggcagcgctctcaggacgtcaccaccatgctgggctctnctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggtcggagggaccaagctgaccgtcctaggtcagcccaaggctcgccccctcggtctacc

SEQ ID NO: 783556 - DNA, 460 bp, Homo sapiens
  misc_feature: HIJSMM301BKN1W.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcacatattactgtcaacagtatgatcgtctcctcaatttcggccctgggaccagatggacatgaacgaa

SEQ ID NO: 783557 - DNA, 503 bp, Homo sapiens
  misc_feature: HIJSMM301AQ0K0.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcacttggtctacagtactgtacgacggcgcaatgttacttctgtcaacactatgcctcctcccccctacaactttcggttcaggggaccgaagttagaacatcaatccgaactgtggctgcaccatcgttcg

SEQ ID NO: 783558 - DNA, 536 bp, Homo sapiens
  misc_feature: HIJSMM301D49FI.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacactttgggtgttcggcggagggaccaggctggaccctccgtaggtcgagccccaaaggcctgcccccctcggtccaactcctgtttccccgacccctt

SEQ ID NO: 783559 - DNA, 512 bp, Homo sapiens
  misc_feature: HIJSMM301DZ89L.53.71.G05.1.454.light.4.raw
  modified_base (324)..(324): a, c, t, g, unknown or other
cgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgancgattctctggctccaactctggggacacggccaccctgaccatcagcagggtcgaagccggagacgaggccgactattactgtcaggtgtgggattttaatagtgatcattggtgttcggtcggagggaccaagctgaccgtcctaggtcagccaaggactgccccctcggtcgactctgttccccg

SEQ ID NO: 783560 - DNA, 509 bp, Homo sapiens
  misc_feature: HIJSMM301BHFAL.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccccgacaatctctgggctccaggctgaggacgaggctgattattactgctgctcatatgcagatggtgacactcccgtggtattcggcgggagggaccaaggtgaccgtcctacggtcagcccaaggcttcgccccctcc

SEQ ID NO: 783561 - DNA, 513 bp, Homo sapiens
  misc_feature: HIJSMM301AMZEM.21.81.H04.1.454.light.4.raw
  modified_base (241)..(241): a, c, t, g, unknown or other
  modified_base (504)..(504): a, c, t, g, unknown or other
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcacgacccgaacggcccaaacccccnctacgtcta

SEQ ID NO: 783562 - DNA, 509 bp, Homo sapiens
  misc_feature: HIJSMM301A6QNP.15.59.F04.1.454.light.4.raw
  modified_base (421)..(421): a, c, t, g, unknown or other
tctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcacaaacactcgctcttctgggtccctgatcgcttctctggctccatccttggaaacaaagctgccctcaccatcacgggggcccaggcagatgatgaatcttgtttattattntgtcctatatatggtgctggctatttcggtcgttcggcggaggaccgaagctgaccgtcctaggtcagccaaggctcgccccctcggt

SEQ ID NO: 783563 - DNA, 500 bp, Homo sapiens
  misc_feature: HIJSMM301AGUCF.15.49.E05.1.454.light.4.raw
tctacgtagccacgaccggtgctcgatttagagcgactagcaacacacaaaggggggaggaactgctcagttaggacccagacggaaccatggaagccccagcgcagcttctcttcctcctgctactctggctaccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatccccagccacgttcagtggcagtgggtctgggacagagttcattctcaccatcagcagcctgcagtctgaagtattttgctagtttattactgtcagcagtataatgactggcctccggacgttcggccgaagggaccgaaggtaggaaatacaaacgaactaggtggctgcaccatt

SEQ ID NO: 783564 - DNA, 447 bp, Homo sapiens
  misc_feature: HIJSMM301CWWP8.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgcccaggcccttgacaacagtttgggtgtttgggtgttcggcggagggaccaagctgaccgtcctaagtcagcccaaggctcgccccctcggtcactctcgttcccgccctcctccgtgtctgat

SEQ ID NO: 783565 - DNA, 489 bp, Homo sapiens
  misc_feature: HIJSMM301ASJTW.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgtatctacttttggtccagggggaccgaggcgtggagatcagacggaact

SEQ ID NO: 783566 - DNA, 504 bp, Homo sapiens
  misc_feature: HIJSMM301CE4NX.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggctagtttattactgtcagcagtattatactactcctctgaccgttcggccgaagggaccaaggtggagatacaaacgaactggtggctgcaccatcttcg

SEQ ID NO: 783567 - DNA, 507 bp, Homo sapiens
  misc_feature: HIJSMM301CMNA1.2.21.B10.1.454.light.4.raw
acgctcgacacacgaccggtgctcgatttagtgtcgtcgcaagaggggagggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccgggacagagtggtaattacatggtgttcggcggaggaccaagctgaccgtcctacgtcagcccaaggctgcccctcggtcactctcg

SEQ ID NO: 783568 - DNA, 534 bp, Homo sapiens
  misc_feature: HIJSMM301A5JAR.21.22.B11.1.454.light.4.raw
  modified_base (380)..(380): a, c, t, g, unknown or other
  modified_base (454)..(454): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagngggctccggtccgaggatgaggctgactattaactgtgcatcacgggacgcaacatgggatgacaatactgggngggttcgggttggttcgggtccgggaggggaccggaaaactaggacccgtaccgttaacgggtccaggcccaaacggccg

SEQ ID NO: 783569 - DNA, 487 bp, Homo sapiens
  misc_feature: HIJSMM301C12AU.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctcgaagatgttggaagttattactgtcagacctatagtggtggcccgctcattttcggcggtagggaccaaggtgcagatacaaacgaactgtggctgcaa

SEQ ID NO: 783570 - DNA, 498 bp, Homo sapiens
  misc_feature: HIJSMM301DR8T3.48.29.C07.1.454.light.4.raw
  modified_base (472)..(472): a, c, t, g, unknown or other
  modified_base (479)..(479): a, c, t, g, unknown or other
  modified_base (486)..(486): a, c, t, g, unknown or other
agtatacatacacgaccggtgctcgatttagagtgctacgaagggaaagggggggaggaactgctcagttaggacccagacggaaccatggaagccccagcgcagcttctcttcctcctgctactctggctcccagatgtcactggagaaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagtattttgcattttattactgtcagcaactataataactgcacgtgacgtgcaaggacaagnggaatanaacgaanagtgcgtgcaca

SEQ ID NO: 783571 - DNA, 501 bp, Homo sapiens
  misc_feature: HIJSMM301AE9DR.48.8.A08.1.454.light.4.raw
agtatacatacacgaccggtgctcgatttagcatactctacaggggggaggaacccctcagttaggacccagagggaaccatggaagccccagctcagcttctcttcctcctgctactctggctcccaggtttttaccggagagattgtgttgacacagtctccagtcaccctgtcattgtctccagggcaaagagccaccctctcctgcagggccaatgagagtattggcaacttcttaggctggtatcaacaaaagcctggccaggctcccaggctcctcatctatgatgcatcccatagggccagaggcatcccagccaggttcagtggcagtgggtctgggacagacttcactctcaccatcagcaccctagaacgtgaagattttgctagtttattactgtcagcaccgtaaaacctggcctctgagtggttttggccaggggaccaagctggacatcaaacgactgtggctgcaccatctgtcttcatctcccgc

SEQ ID NO: 783572 - DNA, 497 bp, Homo sapiens
  misc_feature: HIJSMM301ETSA2.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctggaggatgttggggtttattactgcatgcaagctctacaaactcccgtcaacgttcgggcgaggggaccaaggtggagatcaaacgaactgtggctcgcaccatctgtcttcta

SEQ ID NO: 783573 - DNA, 477 bp, Homo sapiens
  misc_feature: HIJSMM301BIEKY.41.8.A08.1.454.light.4.raw
tctatactatcacgaccggtgctcgatttagcatactctacagggggcaggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtgggtcccatcaaggttcagcggcagtggatctgggacagatttcactctcaccatcagcagcctgcagcctgacgtattttgcaacttactattgtcaacaggctaacagtttcccgatgaccgtcggccaagggacacgactggacattaaacgaactgtggctgca

SEQ ID NO: 783574 - DNA, 485 bp, Homo sapiens; identical to SEQ ID NO: 539423
  misc_feature: HIJSMM301CBXAC.46.35.D02.1.454.light.4.raw

SEQ ID NO: 783575 - DNA, 499 bp, Homo sapiens
  misc_feature: HIJSMM301ANU89.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcaggcgggtctgggacagatttcactctcaccatcagcagcctgcaggttgaagatgtggctagtttattactgtcagcagtattatactactcctctggtacgttcggccaagggaccaaggtggagatacaaacgaactgtggctgcaccat

SEQ ID NO: 783576 - DNA, 522 bp, Homo sapiens
  misc_feature: HIJSMM301E1U3J.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctagggaacacagccactctgaccatcagcgggacccaacttttagatgaggccgactatttctgttcacacgtgggacagtgggcactgcgtatcgtttccggcgggacggggaccaaagcctacggacccggtccgtgggtccagcccaaggccgtcgccccctcggtccacttcccg

SEQ ID NO: 783577 - DNA, 484 bp, Homo sapiens
  misc_feature: HIJSMM301EWW07.51.60.F05.1.454.light.4.raw
  modified_base (464)..(464): a, c, t, g, unknown or other
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtggttcggacggagggaccaagctgaccgtccncggtcagcccaaggctcccg

SEQ ID NO: 783578 - DNA, 485 bp, Homo sapiens
  misc_feature: HIJSMM301ANGOY.41.17.B06.1.454.light.4.raw
  modified_base (355)..(355): a, c, t, g, unknown or other
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttacnctcaccatcaacggcctgcagtctgaagattctgctagtttattactgtcagcagtatgttgactggcctccgctcactttcggcggagggaccaaggtggagatcagacgaactggtggctgcaccatt

SEQ ID NO: 783579 - DNA, 501 bp, Homo sapiens
  misc_feature: HIJSMM301ATAQU.51.71.G05.1.454.light.4.raw
cgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatccctgagcgattctctggctccaggtcagggacaacggtcacattggccatcagtggagtccaggcagagggacgaggctgacttattattgtcaatcaacagacaccattggtacttatgtcttcggaactgcgaccaaggtccaccgtcctgggtcacgcccaaggcccaaacccccact

SEQ ID NO: 783580 - DNA, 500 bp, Homo sapiens
  misc_feature: HIJSMM301C0VY1.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaactttattactgtcatcagagtactactttacctcaagtgatcaccttcggccaagggacacgacgtggagtaattaaacgaactagtggctgcaccatctgtactt

SEQ ID NO: 783581 - DNA, 493 bp, Homo sapiens
  misc_feature: HIJSMM301EIGN8.47.60.F05.1.454.light.4.raw
  modified_base (391)..(391): a, c, t, g, unknown or other
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggcctcctcatctttgatgcgtccaccagggccactggtttcccagccaggttcagtggcagtgcgtctgcgacagagttcactctcaccatcaacagcctgcagtctgaagtnttttgctagtttattactgtcagcagtatcatgactggccgctcaccttcggccaagggcacgactggagacttaaacgaactgtggctgctaccattctcg

SEQ ID NO: 783582 - DNA, 520 bp, Homo sapiens; identical to SEQ ID NO: 537173
  misc_feature: HIJSMM301CCHDE.27.23.C01.1.454.light.4.raw

SEQ ID NO: 783583 - DNA, 496 bp, Homo sapiens
  misc_feature: HIJSMM301DHS32.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaaccctcctcaacttctgatataccgttcatcgctgttgcacgttggggtcccacctcggttcagtggcaacggctctgagacagtatttttctctcgtcatcactggtctacagtctgacgacggcgcaatgtacttctgtcaacactatgcctcctcccccctactaatttcggtcagggaccaagttgaacatcaatcgaactgtggctgcaccatcttcg

SEQ ID NO: 783584 - DNA, 525 bp, Homo sapiens
  misc_feature: HIJSMM301ANYW6.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccccctctcc

SEQ ID NO: 783585 - DNA, 504 bp, Homo sapiens
  misc_feature: HIJSMM301DOW25.18.23.C01.1.454.light.4.raw
  modified_base (408)..(408): a, c, t, g, unknown or other
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagtattttgcaacttactattntcagcaggcgcacaatttccccgctcactttcggcggagggaccaaggtggagatcaaacgaactgtggctgcaccatctgtcttcatcttccccg

SEQ ID NO: 783586 - DNA, 492 bp, Homo sapiens
  misc_feature: HIJSMM301B6T2Y.52.60.F05.1.454.light.4.raw
cgcagtacgacacgaccggtgctcgatttagtacgtcatcagggaaagggggctgtgggtccaggaggcagaactctggatgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtctaggtcagcccaaggccaaccccactgt

SEQ ID NO: 783587 - DNA, 490 bp, Homo sapiens
  misc_feature: HIJSMM301AJO2N.47.64.F09.1.454.light.4.raw
agctcacgtacacgaccggtgctcgatttagcgcgtatacaagggggagggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggagggaccagggtggagatcaacgaactggtggctgcacatctgtctt

SEQ ID NO: 783588 - DNA, 523 bp, Homo sapiens
  misc_feature: HIJSMM301B7WM2.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaattctctgggctccagtctgacgacgaggctgatttattactgcagctcatatgcagtttggttcctcttttcaagatatttcgggcggaggggaccagggctcggaccgtccttgaagtcaacgaccgaaggcctccgccccccgg

SEQ ID NO: 783589 - DNA, 538 bp, Homo sapiens
  misc_feature: HIJSMM301A8IRW.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgaacggacgaggctgattattactgcagctacaatatgctagtttgggtttcccttcttttctaaagtatagttccgggtcgggtaggggacccgagggctcgacccgttccgtgagtcagcccgaacggctcggtcccccccg

SEQ ID NO: 783590 - DNA, 505 bp, Homo sapiens
  misc_feature: HIJSMM301AO9WQ.21.81.H04.1.454.light.4.raw
  modified_base (497)..(497): a, c, t, g, unknown or other
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggcccaacccnctagtcta

SEQ ID NO: 783591 - DNA, 516 bp, Homo sapiens
  misc_feature: HIJSMM301A3LY0.19.72.G06.1.454.light.4.raw
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattatgctgcgcatacgcaggaagtaagcacatgggtgtggcgggcggaggggaccaagggtgaccggtcctgggtcagcccaagggctgccccctcggtcacgtt

SEQ ID NO: 783592 - DNA, 518 bp, Homo sapiens
  misc_feature: HIJSMM301EQGZ6.7.34.D01.1.454.light.4.raw
cgtgtctctacacgaccggtgctcgatttagatcgtctgtgttgggtttggggggggtcgtcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacgaggggacagctatttatttgggtgttcggcggagggaccaagctgaccgtcctgcgtcacgcccaaggctcgccccctcggtccact

SEQ ID NO: 783593 - DNA, 475 bp, Homo sapiens
  misc_feature: HIJSMM301DG4ZZ.5.15.B04.1.454.light.4.raw
atcagacacgcacgaccggtgctcgatttagacagtatatatccgcgggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcgcagtggatcgtgggacagaattcactctcaccatcagcagcctgcagcctgatgatgctgcacttattactgtcaacatataactagttattggacgttcggccaaggaccaaggtggaatcaaacgactgtaggctgcaccta

SEQ ID NO: 783594 - DNA, 511 bp, Homo sapiens
  misc_feature: HIJSMM301A4CZN.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagctaggttttcggcggtgggaccaagctgaccgtcctaagtcagcccaaggctgccccctcggtcactctcgtt

SEQ ID NO: 783595 - DNA, 489 bp, Homo sapiens; identical to SEQ ID NO: 555050
  misc_feature: HIJSMM301BUJ2U.14.55.E11.1.454.light.4.raw

SEQ ID NO: 783596 - DNA, 477 bp, Homo sapiens
  misc_feature: HIJSMM301D0XES.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggtttcggcggagggacaagctgaccgtcctaagtcagacccc

SEQ ID NO: 783597 - DNA, 492 bp, Homo sapiens
  misc_feature: HIJSMM301B4MHQ.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatggttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggtattttgcaacttactactgtcagcaggctaacaggctcgcccccaaccttccggccaggggacacggactggagaattaaacgaacttacgtggctgcaccatct

SEQ ID NO: 783598 - DNA, 416 bp, Homo sapiens
  misc_feature: HIJSMM301AXZ1W.18.78.H01.1.454.light.4.raw
  modified_base (262)..(262): a, c, t, g, unknown or other
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctntgggctccaggctgaggacgaggctgattattactgcagctcatatacaagcagcagcacttaagtcttcggaactgggaccaaggtcaccgtcctaggtcagcccaaggccaaccccactgtcactctgttcccaccctcctccatactcgta

SEQ ID NO: 783599 - DNA, 508 bp, Homo sapiens
  misc_feature: HIJSMM301EWV9K.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatggaggctgactattactgcagctcatttgcaggcagccgtatactcttcgggcggacgggaccaagctgaccgtcctaggtcagcccaaggctcgccccctcggtcta

SEQ ID NO: 783600 - DNA, 512 bp, Homo sapiens
  misc_feature: HIJSMM301D62T6.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgcacactggtaccaacagatgccaggccaggcccctgtgctggtcgtctatgatgatagtgaccggccctctgggatccccgagcgattctctggctccaagtctgggaacacggccacctgaccgtcagcagggtcgacgtcggggatgaggccgtatatttttgtcaggtgtgggagactaattttggtctagtatgttgttcggcggagggaccaagctgaccgtcctcggtcagccaaggctgccccctcggcactctgtcccaccct

SEQ ID NO: 783601 - DNA, 484 bp, Homo sapiens
  misc_feature: HIJSMM301AHMOU.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactggggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctgtcatcgctgggctccaggctgacgatgaggctgattattattgccagtcctatgacaacaccctgcgtggttttggtcttgttcggtcggcgggacc

SEQ ID NO: 783602 - DNA, 490 bp, Homo sapiens
  misc_feature: HIJSMM301AQWV7.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagtcgttcggccgtaggggaccaaggtggaagtcaagcgaactgtgctgcaccatctgt

SEQ ID NO: 783603 - DNA, 491 bp, Homo sapiens
  misc_feature: HIJSMM301DBJMR.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagaattttacactgaaaatcagcagagtggaggctgaggatgttgggctctattattgcatgcaagctactacaagtcccgctcactttcggcggagggaccaagggtggagatacaaacgaactt

SEQ ID NO: 783604 - DNA, 456 bp, Homo sapiens
  misc_feature: HIJSMM301ASLLJ.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtccgtcgggcccacgtctgtgctgactcagccaccctcagcgtcgtcggggacccccgggcaggagggtccaccatctcttgttctggaggcaactccaacagtcggaagtaattatgtattctggtatcagcaactcccgaggaatcggacccccaaactcctcatccagaggaataactcagcggccctcgacggggtcccttcgaccgtattcctcgtggcctccaagttctggcctaaccctcgacgccctcccctaggacctaagtccaggtcggggccttcccggggtaccggagggtaactcgggaggg

SEQ ID NO: 783605 - DNA, 500 bp, Homo sapiens
  misc_feature: HIJSMM301E2H8V.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagttctattactgtcagcagtatggtcacggtcccaagaacttttggcctaggggaccaaaggcctggagatacaaacgtaactcgtgggctgcaccaatctt

SEQ ID NO: 783606 - DNA, 507 bp, Homo sapiens
  misc_feature: HIJSMM301A2DOE.43.9.A09.1.454.light.4.raw
  modified_base (279)..(279): a, c, t, g, unknown or other
  modified_base (371)..(371): a, c, t, g, unknown or other
  modified_base (463)..(463): a, c, t, g, unknown or other
tgtgagtagtcacgaccggtgctcgatttagcgagacgcgcaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggtcaggccccccgganactgattatgatacaagcaacaaactttcctggacacctgcccgattctcaggctcctccttggggcaaagctgccctgaccctttcgggtncgcagcctgaggatgaggctgactattactgcttgctcgcctatgatgctgctcgggttttcgcggagggaccaagttgaccgtctaggtcngcccaaggctcgccccctcggtcactctgttcccgccctcctca

SEQ ID NO: 783607 - DNA, 500 bp, Homo sapiens
  misc_feature: HIJSMM301EPCRH.19.78.H01.1.454.light.4.raw
tactctcgtgcacgaccggtgctcgatttagtgtgagtagtttggggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgagggacgaggctgattactactgctgctcaatatgcaggtcgtatcttcttatgtcttcggaactgggaccaaggtcacgtcctaggtcagcccgaagcccaacccc

SEQ ID NO: 783608 - DNA, 506 bp, Homo sapiens
  misc_feature: HIJSMM301ALAKJ.47.64.F09.1.454.light.4.raw
agctcacgtacacgaccggtgctcgatttagcgcgtatacaagggggagggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctggggacagacttcactctcaccatcagcagcctagagcctgaagactttggactttattactgtcagcagcgttgagttctggcctccggctcactttcggcgggacggggaccaggggtggaggatcaaacgaactggtggctgcaccatctgtcttcattccc

SEQ ID NO: 783609 - DNA, 507 bp, Homo sapiens
  misc_feature: HIJSMM301AYY6V.41.45.E01.1.454.light.4.raw
tctatactatcacgaccggtgctcgatttagtgagtcagtaagggaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcgggggaccgaagctgaccgtcctacggtcagcccaagctcgccccctcggtccactccg

SEQ ID NO: 783610 - DNA, 522 bp, Homo sapiens; identical to SEQ ID NO: 602089
  misc_feature: HIJSMM301DDKOO.27.23.C01.1.454.light.4.raw

SEQ ID NO: 783611 - DNA, 496 bp, Homo sapiens
  misc_feature: HIJSMM301AHW3S.47.55.E11.1.454.light.4.raw
agctcacgtacacgaccggtgctcgatttagcactcgcacgttgggtttgggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaaggtcacccgtcctaggtcagcccaaggccaacccccactgtcactctgttccccaccctcctctacgtgagct

SEQ ID NO: 783612 - DNA, 486 bp, Homo sapiens
  misc_feature: HIJSMM301DHO97.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagatagtaccggagaaattgtgttgacgcagtctccaggcaccctgtctttgtctccaggggaaagagccaccctctcctgcagggccagtcagagtgtcagcagcggctacttaggctggtaccagcagaaacctggccaggctcccaggctcctcatctatggtgcatccagcagggccactggcatcccagacaggttcagtggcagtgggtctgggacagacttcattctcaccatcagcggactggagcctgaagtattttgcagtgtattactgtcagcagtatggtaactcatcgtactactttgggccagggaccaagctggagactcaaacgactgtgctgcac

SEQ ID NO: 783613 - DNA, 521 bp, Homo sapiens
  misc_feature: HIJSMM301EVTIG.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtaggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatcgtgatcttcgggcggggggaccaaggcctgaccggttcctaggtccagcccccaaaggcctgtcccccccg

SEQ ID NO: 783614 - DNA, 520 bp, Homo sapiens
  misc_feature: HIJSMM301BBCL1.27.23.C01.1.454.light.4.raw
  modified_base (466)..(466): a, c, t, g, unknown or other
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgacccatctccgggctccagcctgagacgaggctgattattaattgtagttcatatacaaccagtgacacttgggtgttcggcggagggaccnggctgacgtcctaggtcaagaccagctgccccctggtcactctgttcccaccct

SEQ ID NO: 783615 - DNA, 487 bp, Homo sapiens
  misc_feature: HIJSMM301C2JUP.26.45.E01.1.454.light.4.raw
  modified_base (470)..(470): a, c, t, g, unknown or other
  modified_base (478)..(478): a, c, t, g, unknown or other
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattacttgcatgcaagctctacaaactcctctcactttcggcggagggaccaaggnggtagatnaaacgaact

SEQ ID NO: 783616 - DNA, 509 bp, Homo sapiens
  misc_feature: HIJSMM301DJOPT.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcacgccaaggctcgccccctcggtcc

SEQ ID NO: 783617 - DNA, 506 bp, Homo sapiens
  misc_feature: HIJSMM301AHJJ0.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagccactcaagtcttacggaactcgggaccaaggtcaccgtcctaggtcagcccaaggcccaaccccca

SEQ ID NO: 783618 - DNA, 491 bp, Homo sapiens
  misc_feature: HIJSMM301D8I5U.52.73.G07.1.454.light.4.raw
cgcagtacgacacgaccggtgctcgatttagctctacgctcagggcacgaccggtgctcgatttagctctacgctcagggcacgaccggtgctcgatttagtgtgagtagtttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacaacg

SEQ ID NO: 783619 - DNA, 508 bp, Homo sapiens
  misc_feature: HIJSMM301BSX8N.17.87.H10.1.454.light.4.raw
cgtagactagcacgaccggtgctcgatttagcagtactgcgttggggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggcctcaggggtttctaatcgcttcgctggctccacgtctggcagcacggcctccctgacaatctctgggctccaggctgaggacgaggctgattattactgctgctcatattcaagtcgtgtcactatgattttggcggtaggcaccaaggtgaaccgtcctaggtcagcccaaggctgccccctcggtcta

SEQ ID NO: 783620 - DNA, 488 bp, Homo sapiens
  misc_feature: HIJSMM301BOMRV.46.26.C04.1.454.light.4.raw
  modified_base (412)..(412): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggntctattattgcatgcaagctctacaagtcccgctcactttcggcggagggaccgaaggtggaggatcaaacgaact

SEQ ID NO: 783621 - DNA, 480 bp, Homo sapiens
  misc_feature: HIJSMM301BJ2A2.52.73.G07.1.454.light.4.raw
cgcagtacgacacgaccggtgctcgatttagctctacgctcaggggtgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaatcagcagagtggaggctgaggatggttggggtttattacgtgcatgcaagttctacaaaatcctacgcacttttggcctaggggaccaagctggagatcaaacgaa

SEQ ID NO: 783622 - DNA, 502 bp, Homo sapiens; identical to SEQ ID NO: 721168
  misc_feature: HIJSMM301APHWT.18.11.A11.1.454.light.4.raw

SEQ ID NO: 783623 - DNA, 448 bp, Homo sapiens; identical to SEQ ID NO: 540364
  misc_feature: HIJSMM301EP7M7.18.9.A09.1.454.light.4.raw

SEQ ID NO: 783624 - DNA, 366 bp, Homo sapiens
  misc_feature: HIJSMM301BMEGO.10.86.H09.1.454.light.4.raw
catagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccacctcctccactactatg

SEQ ID NO: 783625 - DNA, 527 bp, Homo sapiens
  misc_feature: HIJSMM301B39OG.13.25.C03.1.454.light.4.raw
tcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggtttcttctgttcggttcgttcggcgggtagggtcccaaaggtgacccgtctacggttcacgcccgaaggcctcgtcccccgtcggtcaccttccc

SEQ ID NO: 783626 - DNA, 501 bp, Homo sapiens
  misc_feature: HIJSMM301B5AM4.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgacccatctctgggctccaggctgaggacgagggtgattattactgcagctcatatagaagtggcagcactctcgtattcggcggtgggaccaagctggaccgtcctaggtcagcccaaggcctcgccccctc

SEQ ID NO: 783627 - DNA, 483 bp, Homo sapiens
  misc_feature: HIJSMM301BC8PV.48.73.G07.1.454.light.4.raw
agtatacatacacgaccggtgctcgatttagctctacgctcagggcacgaccggtgctcgatttagtagcatactgttgggtttgggggctgtgggtccaggaggcagaactctgggtgtctcaccatggcctggatccctctacttctccccctctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactatattgtcagtcaggagacaatactcgcacgcaagtacgtgttcggac

SEQ ID NO: 783628 - DNA, 484 bp, Homo sapiens; identical to SEQ ID NO: 722089
  misc_feature: HIJSMM301D3TQ5.46.35.D02.1.454.light.4.raw

SEQ ID NO: 783629 - DNA, 509 bp, Homo sapiens
  misc_feature: HIJSMM301D12VU.5.60.F05.1.454.light.4.raw
atcagacacgcacgaccggtgctcgatttagtacgtcatcaggggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacagtggatgcagcctgaatggtccggtattcgggcggagggaccaagctgaccgtctcggtcagcccaaggctcgcccccg

SEQ ID NO: 783630 - DNA, 378 bp, Homo sapiens
  misc_feature: HIJSMM301D1U52.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcgttcccgggagtccggggtccctgaccgattcagtgccagcgggtctgggacagacttcactctcacca

SEQ ID NO: 783631 - DNA, 517 bp, Homo sapiens
  misc_feature: HIJSMM301A6YFV.22.30.C08.1.454.light.4.raw
  modified_base (433)..(433): a, c, t, g, unknown or other
  modified_base (506)..(506): a, c, t, g, unknown or other
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtcnggctgttcggcggagggacaagctgaccgtcctaggtcacgccaaggctcgccccctcggtcactctgtcccnccctcctcacg

SEQ ID NO: 783632 - DNA, 491 bp, Homo sapiens
  misc_feature: HIJSMM301AVSAA.11.11.A11.1.454.light.4.raw
  modified_base (340)..(340): a, c, t, g, unknown or other
  modified_base (411)..(411): a, c, t, g, unknown or other
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcaagcaaaaaccaggacagcctcctaaactgctcatctcctgggcatctacccgggcaccccggagtccctgaccgattcagtggcagcgggtctgggacngacttcactctcaccatcagcaacctgcaggctgaagatgtggctagtttattactgtcagcagtattgtnaagctccgactcactttcgggcggagggacccgcggtggagagtcaggaccgaactggttggcctgcaccatctcgtctt

SEQ ID NO: 783633 - DNA, 529 bp, Homo sapiens
  misc_feature: HIJSMM301D51NW.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccaggaccgaaggtaggaagtacaacgaactagtaggtcgtcgcgaccactacctcgtcttctacttaccttccccgtccctactccttcgt

SEQ ID NO: 783634 - DNA, 500 bp, Homo sapiens
  misc_feature: HIJSMM301CCDD1.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgttacccctggagagccggcctccatctcctgcaggtccagtcagagcctcctgcatagaaatggatataactatttggattggtatctgcagaggccagggcagtccccacaactcctgatctatggggttctaatcgggcctccggggtccctaacaggttcagtggcagtggatcaggcacagattttacactgaaaatcagcagagtggaggctgaggatgttggggtttattactgcatgcaagctctacaacctctgcggacttcggccctcgggaccaaagtggagatacaaacgaacgtagtggctgcaccatactgtcttcta

SEQ ID NO: 783635 - DNA, 488 bp, Homo sapiens
  misc_feature: HIJSMM301A4PV1.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccaggtcacgtcctaggtcagcccaaggccaacccactcg

SEQ ID NO: 783636 - DNA, 505 bp, Homo sapiens
  misc_feature: HIJSMM301CCMYL.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggcccttcaggggtttctaatcgcttctctggctccagtctggcaacacggcctccctgaccatctctgggctccaggctgatgacgaggctgattattactgcaggtcatatgcaatcagcaacacttatgttcttcgggactgggaaccaagactcaccgtcctaggtcagcccaacggccaacccccactgt

SEQ ID NO: 783637 - DNA, 512 bp, Homo sapiens
  misc_feature: HIJSMM301AGQYE.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaactaatttcgttatactccgccgacggttcggccgggggaccgaccgtaggaatcaaacgaactagtggctgcaccatctgtctt

SEQ ID NO: 783638 - DNA, 498 bp, Homo sapiens
  misc_feature: HIJSMM301DDAHU.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaactccctctaacggttcggcggagggaccaagggtggagatcaaacgaacgtagtggctgcaccatctgtcttcta

SEQ ID NO: 783639 - DNA, 524 bp, Homo sapiens
  misc_feature: HIJSMM301BPTT3.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcgggagggaccgaggctcgaccgtcctaggtcagcccaacggctcgccccctcggtccactctcgttccc

SEQ ID NO: 783640 - DNA, 450 bp, Homo sapiens
  misc_feature: HIJSMM301BVHLP.18.9.A09.1.454.light.4.raw
  modified_base (432)..(432): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaagggtcaccgtcctaagtcagccccaaggccaacccctctgtcactctgttccccnccctcctcatactcgtaa

SEQ ID NO: 783641 - DNA, 503 bp, Homo sapiens
  misc_feature: HIJSMM301EEFCW.14.59.F04.1.454.light.4.raw
cgtctagtaccacgaccggtgctcgatttagtacacacacttagggattgggggatcaggactcctcagttcaccttctcacaatgaggctccctgctcagctcctggggctgctaatgctctgggtctctggatccagtggggatattgtgatgactcagtctccactttccctgaccgtcacccctggagagccggcctccatctcctgcaggtctagtcagagcctcctgcatactaatggaaacaactttttggattggtacctgcagaagccagggcagtctccacagctcctgatctatttgggttctaatcgggcctccggagtccctgacaggttcagtggcagtggatcaggcacagattttacactgaaaatcagcagagtggaggctgaggatggtttggggtttattactgcatgcaagctctacaaactcgaacgttcggccaagggaccaaggtggaaatacaaacgaactgtggctgcaccatctgtt

SEQ ID NO: 783642 - DNA, 494 bp, Homo sapiens; identical to SEQ ID NO: 534994
  misc_feature: HIJSMM301DSOR7.27.78.H01.1.454.light.4.raw

SEQ ID NO: 783643 - DNA, 481 bp, Homo sapiens
  misc_feature: HIJSMM301CN1VE.51.29.C07.1.454.light.4.raw
cgatcgtatacacgaccggtgctcgatttagagtgctacgaagggaaagggggaatcagtcccactcaggacacagcatggacatgagggtccccgctcagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcagcctgaagatttttcaacttataagtgtctacatcataattcttaggaggagatcacatgttggaactgtggctgcaccatctgtcttcatcttcccgccat

SEQ ID NO: 783644 - DNA, 503 bp, Homo sapiens
  misc_feature: HIJSMM301AF9CZ.40.35.D02.1.454.light.4.raw
tctagcgactcacgaccggtgctcgatttagcacacgatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgcttgctcttatgcaggcagtttcgctctcgaagtgttcggcggagggaccgagctgaccgtcctacgtcacgcccaaggctcccgg

SEQ ID NO: 783645 - DNA, 478 bp, Homo sapiens
  misc_feature: HIJSMM301BM9G9.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtgttttggctgttcgcggcgggcc

SEQ ID NO: 783646 - DNA, 501 bp, Homo sapiens
  misc_feature: HIJSMM301DD8ZR.41.28.C06.1.454.light.4.raw
  modified_base (366)..(366): a, c, t, g, unknown or other
  modified_base (462)..(462): a, c, t, g, unknown or other
  modified_base (473)..(473): a, c, t, g, unknown or other
tctatactatcacgaccggtgctcgatttagagctcacgtattgggtttgggggaaaaggccctgaggaagacaaaccccagctgtgaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgacctcaggctcagtctctcctagtaattacgccagctggtaccagcagaccccaggccagcctccacgcatcctcatctactacacggacactcggtcttctgggtccctgntcgcttctctggctccatccttagggaacaaagctgccctcaccatcacggggcccaggcagatgatgaatctgattattactgtgcgcttatttntgtataacgtnaagttgggtactttgggcggtagggacc

SEQ ID NO: 783647 - DNA, 515 bp, Homo sapiens
  misc_feature: HIJSMM301AKC5W.19.72.G06.1.454.light.4.raw
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaaggaagtagcacagtgggtgtggcgggcggagggaccaagctgaccgtcctaagtcagcccaaggcctcgccccctcggtctacc

SEQ ID NO: 783648 - DNA, 489 bp, Homo sapiens
  misc_feature: HIJSMM301EU79I.48.51.E07.1.454.light.4.raw
  modified_base (409)..(409): a, c, t, g, unknown or other
agtatacatacacgaccggtgctcgatttagcatactctacaacacacaaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagattttcactctcaccatcagcagcctgcagcctgaagattctgcaaacttnttactgtctacacgattacaattaccctcgtaccgtttcggccaaaggggacccaaggtggaaaatcaaaacgaactggt

SEQ ID NO: 783649 - DNA, 510 bp, Homo sapiens
  misc_feature: HIJSMM301CVGEG.43.67.G01.1.454.light.4.raw
tgtgagtagtcacgaccggtgctcgatttagagtatacatattgggtttggggacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaactaatttcgttatactccgccgacgttcggccggggaccgaccgtacggaaatacaaacgaactgtaggctgctacccatacttcgt

SEQ ID NO: 783650 - DNA, 527 bp, Homo sapiens
  misc_feature: HIJSMM301AV1DE.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtagacacttgggtgttcggcggagggaccaggctgaccgtcctaaggtcacgcccaaggctcgccccctcggtcactctcgttcccaccct

SEQ ID NO: 783651 - DNA, 494 bp, Homo sapiens
  misc_feature: HIJSMM301AV3WW.26.12.B01.1.454.light.4.raw
  modified_base (478)..(478): a, c, t, g, unknown or other
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctggggacagaattcactctcaccatcaccagcctgcagtctgagattttgcagtctattactgtcagcaatataattactggctctctttcggcgggggaccaagctggagatcaaccgaactgnggctgcaccatctgtt

SEQ ID NO: 783652 - DNA, 500 bp, Homo sapiens
  misc_feature: HIJSMM301BIXK0.15.1.A01.1.454.light.4.raw
tctacgtagccacgaccggtgctcgatttagacgtctcatcagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccacaccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtct

SEQ ID NO: 783653 - DNA, 508 bp, Homo sapiens
  misc_feature: HIJSMM301AQY7V.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacggggcccaggcagatgatgaatcttgtttattattgtgtcctatattatgggtgctggctatttcggtctttcggcggagggaccaagctgaccgtcctaggtcacgcccgaaggcctcgccccctcggtccacctctcgttccccaccctcctccgactaccgtaga

SEQ ID NO: 783654 - DNA, 447 bp, Homo sapiens; identical to SEQ ID NO: 535201
  misc_feature: HIJSMM301EKBR6.18.9.A09.1.454.light.4.raw

SEQ ID NO: 783655 - DNA, 517 bp, Homo sapiens
  misc_feature: HIJSMM301ASHA6.9.21.B10.1.454.light.4.raw
tgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgaggtcactaagcggccctcaggggtttctggtcgcttctctgcctccaagtctggcaacacggcctccctgacaatctctgggctcagtctgacgacgaggctgatttattactgcagctcatatgcagtttggttccctctttcaagattagttcggcggagggaccagggctggaccgtccgtgagtcacgcccaaggctccgtccccccg

SEQ ID NO: 783656 - DNA, 514 bp, Homo sapiens
  misc_feature: HIJSMM301DQHWI.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaaggccggggatgaggccgactattactgtcaggtgtgggataatggtggtgatcatccggtcttcggcggagggaccagttgaccgtcctaagtcagcccaaggctcgcccctcggtcactctcgttcccgccctcctcta

SEQ ID NO: 783657 - DNA, 502 bp, Homo sapiens
  misc_feature: HIJSMM301CM5IF.15.66.F11.1.454.light.4.raw
  modified_base (491)..(491): a, c, t, g, unknown or other
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattattctgcggctcatatggagacaattacagctttgtcttcggaagtgggaccaaggtcacgtcctaagtcagcccaaggccaacccactgtcactcngttcccaccct

SEQ ID NO: 783658 - DNA, 503 bp, Homo sapiens
  misc_feature: HIJSMM301A1MUC.19.71.G05.1.454.light.4.raw
tactctcgtgcacgaccggtgctcgatttagtgtcgtcgcaagagagagggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattaattatacttcgtggacgttcggccgaacgggaccaaggtggagtatcaagacgaactgtggcgtgca

SEQ ID NO: 783659 - DNA, 514 bp, Homo sapiens
  misc_feature: HIJSMM301EMY25.17.37.D04.1.454.light.4.raw
cgtagactagcacgaccggtgctcgattttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcgtcactctgttcccaccct

SEQ ID NO: 783660 - DNA, 533 bp, Homo sapiens
  misc_feature: HIJSMM301AF171.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacggctccgacaacaagaactacttagcttggtatcagcagaaaccaggacagcctcctaaactgctcattaactgggcatctacccggcaatccggggtccctgaccgattcagtggcagcgggtctgggacagtatttcactctcaccatcagcagcctgcaggctgaagatgtggctagtttattactgtcaactagttttcgtcggggcgttcggccgtaacgggaccgaaggtaggaaagtacaaacgtaaactgtcggctggtaccacctaactcttgttcctttcacttctttcccccg

SEQ ID NO: 783661 - DNA, 505 bp, Homo sapiens
  misc_feature: HIJSMM301EC7XD.18.78.H01.1.454.light.4.raw
tacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcataatcggccctcaggggtttctaatcgcttctctggctccaagtctggcaacacggcctcctgaccatctctgggctccaggctgaggacgaggctgattattactgcagctcatatacaagcagcagcactcaagtcttcggaactgggaccaaggtcacgtcctaggtcagcccaaggcccaacccactgtcta

SEQ ID NO: 783662 - DNA, 524 bp, Homo sapiens
  misc_feature: HIJSMM301B563O.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacacccccggcgaaagccccccaaactccctcatttatgaggtcactaagcggcccttaggggtccctgatcgcttctctggctccaagtctggcagaacggcctccctgaccgtctctgggctccaagctgaggatgaggctgattattactgcagctcatatgcaggcaggcagcaatcgtacttttcggcggtagggaccaagctgacccgtccgtagggtctacgcccaagggcctcgcccccctcggtcctaccg

SEQ ID NO: 783663 - DNA, 499 bp, Homo sapiens
  misc_feature: HIJSMM301AKTEM.48.67.G01.1.454.light.4.raw
agtatacatacacgaccggtgctcgatttagagtatacatattgggtttgggggtgggtccaggaggcagaactctgggtgtctcaccatggcctggatccctctacttctcccccctcctcattctctgcacaggctctgaggcctcctatgaactgacacagccaccctcggtgtcagtgtccccaggacagacggccaggatcacgtgctctgcagagacgttgccaagtcaatttggttttttggtatcagcagaagtcaggccaggccccaagactgctcatgtatagagacagtgagaggtcctcagggatccctgagcgattctctggctccagctctgggacacactcactctgactatcagtgaagtccgggcagaagacgaggctgactactattgtcagtcaggagacaatactcgcacgcaagtactgttcggcggagggaccaagctgacagtcctacgggtcacggcccaaggctcgtccccccg

SEQ ID NO: 783664 - DNA, 505 bp, Homo sapiens
  misc_feature: HIJSMM301BZYOR.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggaggaccaagctgaccgtcctaggtcagccaaggctcgcccctcggt

SEQ ID NO: 783665 - DNA, 490 bp, Homo sapiens
  misc_feature: HIJSMM301CZDUM.16.86.H09.1.454.light.4.raw
  modified_base (446)..(446): a, c, t, g, unknown or other
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgccccaaactcatgatttatgagtcagtaatcggcctcaggggtttctaatcgcttctctggctccaagtctggcaacgacggcctccctgaccatctctgggctccaggctgaggacgaagggtgattattactgcagctcatatagaagtggcagcactntcctagttcgcggtggaccgagactgaccgtcctaggtcacgcc

SEQ ID NO: 783666 - DNA, 502 bp, Homo sapiens
  misc_feature: HIJSMM301BOUSH.43.34.D01.1.454.light.4.raw
  modified_base (469)..(469): a, c, t, g, unknown or other
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcagtcaccatctcctgcactggaagcagcagtgacattggtggttatacatatgtctcctggtaccaacagcacccaggcaaagccccaaactcatgatttatgaggtcaataagcggccgtcaggggtccctgatcgcttctctggctccaagtctggcaacacggcctccctgaccatctctgggctccaggctgaggacgaaggctgattatactgcaactcacttacaacaccggacacttgcgtattcggcgcgggaccaaggcctnaccgtcctaggtcagccaacgcgtgtccccccg

SEQ ID NO: 783667 - DNA, 492 bp, Homo sapiens
  misc_feature: HIJSMM301BHM75.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactggaccaaggtcaccgtcctaggtcagcccaaggccaaccccactgtcactctcg

SEQ ID NO: 783668 - DNA, 501 bp, Homo sapiens
  misc_feature: HIJSMM301DQK6H.40.81.H04.1.454.light.4.raw
tctagcgactcacgaccggtgctcgatttagtagtgtagattcgcgggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagtattttacactagaaaatcagcgagggtggaggcagaagatggttgggtatttattactgcatgcaacctctaacaaactgtgtggacggtcggccgaagggaccgaaggtaggaaatcaagcgaactgtggctgctaa

SEQ ID NO: 783669 - DNA, 490 bp, Homo sapiens
  misc_feature: HIJSMM301BVESS.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactagaaaatcagcagagtggaggctgaggatgttgggctctattattgcatgcaagctctacaagtcccgctcactttcggcggagggaccaaggtggaagtatacaaacgaact

SEQ ID NO: 783670 - DNA, 494 bp, Homo sapiens
  misc_feature: HIJSMM301EKCMT.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccgaagggacacgactggagattaaaggactgtggctgcaccatctgtcttcatccttccccg

SEQ ID NO: 783671 - DNA, 507 bp, Homo sapiens
  misc_feature: HIJSMM301C8JJS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcgccgacggaaccgaaggtaggaatacaaacaactagtggctgcaccatactgtcttcattcttccccg

SEQ ID NO: 783672 - DNA, 498 bp, Homo sapiens
  misc_feature: HIJSMM301EMX1I.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtccaccgtcctaggtcacgcccaaggcccaaccct

SEQ ID NO: 783673 - DNA, 519 bp, Homo sapiens
  misc_feature: HIJSMM301DUQG7.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaacgcccctaagctcctgatctataaggcgtctagtttagagagtggggtcccatcaaggttcagcggcagtgaaactgggacagaattcattctcaccatcagcaagcctgcagcctgatgagttttgcaactttattactgccaacagtataagagttataccgtggtacgttcggccaagggaccgagggtaggaaatacaaacggaactaggtggctcggtcaccgactctgttcttctacttcccg

SEQ ID NO: 783674 - DNA, 496 bp, Homo sapiens
  misc_feature: HIJSMM301EJXGA.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgctttctctggatccaactctgggaacacagccactctgaccatcagcgggacccaacttttagatgaggccgactattctgtcacacgtgggcatgggcactgcgatcttcggcggagggaccaagctaggaccgtcctgggtcagcccaaggctgccccctcggtccact

SEQ ID NO: 783675 - DNA, 494 bp, Homo sapiens
  misc_feature: HIJSMM301A6MF9.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgtgg

SEQ ID NO: 783676 - DNA, 529 bp, Homo sapiens
  misc_feature: HIJSMM301BU396.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaaccctcaccatcaggggtctacagcctgaagattttgcgacttactattgtcaacagagttaccttctcccccggacgttcgtccgaacggacgaacggtaggaaagtacgaacgacgtaacgtagtacggcgtcgcgaccgactactcgtcgttctaacttccttcccgt

SEQ ID NO: 783677 - DNA, 495 bp, Homo sapiens
  misc_feature: HIJSMM301AW91O.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggcctagactcctaatctatggtgcgtcccggttgcacagtggcgtcccaggaagattcagcggcggtggatctagggcagtatttcactctcaccatcaatcacctgcaggctgaggtattttgctaacttactactgtcagcaggctaacaggcctcgccccccaaccttccggccaggggacacgactgggagattaaacgaacgtgtggctgcaccatctcgtt

SEQ ID NO: 783678 - DNA, 515 bp, Homo sapiens
  misc_feature: HIJSMM301EHYOS.2.35.D02.1.454.light.4.raw
  modified_base (463)..(463): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaacaacaccccggcgaagcccccaaactcctcatttatgaggtcactaagcggcccttaggggtccctgatcgcttctctggctccagtctggcagaacggcctcctgaccgtctctgggctccaagctgaggatgaggctgattattactgcagctcatatgcaggcagcagcaatgtacttttcggcggtagggaccaagcncgtaccgtcctcgggttcacgcccaaagggcctcgccccccgtccggtccta

SEQ ID NO: 783679 - DNA, 519 bp, Homo sapiens
  misc_feature: HIJSMM301E0YC7.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcacctctcgttccc

SEQ ID NO: 783680 - DNA, 491 bp, Homo sapiens
  misc_feature: HIJSMM301CYFO4.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtgcagtgggctgggacagacttcactctcaccatcagcagactggagcccgaagatttgcagtctattactgtcagcagtatggtcacgtcccaagaacttttggccaggggaccaaggctggaggatcaaacgaactgtggctgcaccactctgtt

SEQ ID NO: 783681 - DNA, 510 bp, Homo sapiens
  misc_feature: HIJSMM301A9ID4.9.55.E11.1.454.light.4.raw
  modified_base (489)..(489): a, c, t, g, unknown or other
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggttgtgggctggtgataatgatcatgcgggggtgttcggcgggaggacaagctgaccgtcctaagtcagcccaaggcncgccccctcggtccactctcg

SEQ ID NO: 783682 - DNA, 502 bp, Homo sapiens
  misc_feature: HIJSMM301BQOSX.40.57.F02.1.454.light.4.raw
tctagcgactcacgaccggtgctcgatttagctcgatatagttgggtttgggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctactttatttttgctgctcttatgcaggcagtttcgctctcgagtggttcggcggagggaccgagctgaccgtcctacgtcacgcccaaggctccg

SEQ ID NO: 783683 - DNA, 491 bp, Homo sapiens
  misc_feature: HIJSMM301C8PBO.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgtcagtctattactgtcagcagtatggtcacgtacccaagtaactttggtccgaggggaccaagctaggagatcaaacgaacgtgtggctgcaccat

SEQ ID NO: 783684 - DNA, 516 bp, Homo sapiens; identical to SEQ ID NO: 627948
  misc_feature: HIJSMM301AI1T1.15.34.D01.1.454.light.4.raw

SEQ ID NO: 783685 - DNA, 493 bp, Homo sapiens
  misc_feature: HIJSMM301EAO78.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaaattggtatcaaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtcgtcccccggacgtcgtccgacggaccgacgacgacgaaagtagtagacgaacgagtacggcgtacgg

SEQ ID NO: 783686 - DNA, 513 bp, Homo sapiens
  misc_feature: HIJSMM301BIDWM.49.65.F10.1.454.light.4.raw
  modified_base (436)..(436): a, c, t, g, unknown or other
agtcgagagacacgaccggtgctcgatttagctacgctctaaggggctggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactggtaccagcagatgccaggccaggcccctgtcctggtcgtctttgatgatagcgaccggccctcagggatccctgagcgattctctggctccaactctggggacacggccaccctgaccatcagcagggtcgaagccggggatgaggccgactatatctgtcaggtgtgggatagtagtagtgctcttccgggggtnttcggcggaggaccaagttgacggtcgttggtcagtccaaggcctgccccctcggtcactctgttcccgccctctct

SEQ ID NO: 783687 - DNA, 517 bp, Homo sapiens; identical to SEQ ID NO: 735397
  misc_feature: HIJSMM301AK6LZ.17.33.C11.1.454.light.4.raw

SEQ ID NO: 783688 - DNA, 383 bp, Homo sapiens; identical to SEQ ID NO: 553009
  misc_feature: HIJSMM301DZZ8X.41.25.C03.1.454.light.4.raw

SEQ ID NO: 783689 - DNA, 502 bp, Homo sapiens; identical to SEQ ID NO: 541971
  misc_feature: HIJSMM301DWFKO.4.39.D06.1.454.light.4.raw

SEQ ID NO: 783690 - DNA, 511 bp, Homo sapiens
  misc_feature: HIJSMM301AL02W.51.86.H09.1.454.light.4.raw
cgatcgtatacacgaccggtgctcgatttagtgctatagacttgggtttggggggatcaggactcctcagttcaccttctcacaatgaggctccctgctcagctcctggggctgctaatgctctgggtcccaggttccagtggggatattgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaagggtacacactggcctgggacgttcggaccgaagggaccaaggtaggaatacaaacgaactgtggctgcaccatctgtcttc

SEQ ID NO: 783691 - DNA, 512 bp, Homo sapiens; identical to SEQ ID NO: 683704
  misc_feature: HIJSMM301AH84J.17.33.C11.1.454.light.4.raw

SEQ ID NO: 783692 - DNA, 505 bp, Homo sapiens
  misc_feature: HIJSMM301CI0L5.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctgggcctccagactgaggacgaggctgattattactgccactcatatagaagtgtactactcctgtggttttcggcggagggaccaagctgaccgtcctaggtcagcccaaggctgccccctcggtcactc

SEQ ID NO: 783693 - DNA, 507 bp, Homo sapiens; identical to SEQ ID NO: 764063
  misc_feature: HIJSMM301CHEOD.3.79.H02.1.454.light.4.raw

SEQ ID NO: 783694 - DNA, 506 bp, Homo sapiens
  misc_feature: HIJSMM301AHJV4.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatccaccaacctgccaccctgaagatgttggaagttattactgtcagacctatagtggtcggcccgctctattttcggcggtacggggaccaagggtgcgtagatacaaaacggaactggtggctggcctaacccg

SEQ ID NO: 783695 - DNA, 497 bp, Homo sapiens
  misc_feature: HIJSMM301B2H7V.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagctttatgttaattcacctccgtcgtacatctttggccaggggaccaaggctggagatacaagaactgtggctgcaccatctgtcttcatt

SEQ ID NO: 783696 - DNA, 531 bp, Homo sapiens
  misc_feature: HIJSMM301AFS2P.4.34.D01.1.454.light.4.raw
agcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcaggggactccctgagcgtattctctggctccagctcagggacaacagtcacgttgaccatcagtggagtccaggcagaagacgaggctgactattactgtcaatcagcagacaggcgggtagggtacttaataaaacgagtttaccgggccgggaagggacccgaagccgtcggacccgtccgtaacgggtcaacggtccccaaacggcctccgtccccccc

SEQ ID NO: 783697 - DNA, 501 bp, Homo sapiens
  misc_feature: HIJSMM301AW68I.51.80.H03.1.454.light.4.raw
cgatcgtatacacgaccggtgctcgatttagctgtgcgtcgaagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctagttcggcggagggaccaagctgaccgtcctaggtcagcccaggctcgcccccg

SEQ ID NO: 783698 - DNA, 485 bp, Homo sapiens
  misc_feature: HIJSMM301CMBZ3.41.78.H01.1.454.light.4.raw
tctatactatcacgaccggtgctcgatttagtgtgagtagtttgggtttgggggatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcgggtccgggacagattcacactgaggatcaggtcgggtggaggctagacgacggttgggacttattactgcgcgcaaagtctacaccttcctctctacgttggccctcgggaccaagtggacatacaacgaa

SEQ ID NO: 783699 - DNA, 503 bp, Homo sapiens
  misc_feature: HIJSMM301B3669.19.67.G01.1.454.light.4.raw
  modified_base (484)..(484): a, c, t, g, unknown or other
tactctcgtgcacgaccggtgctcgatttagagtatacatattgggtttgggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccagctgaccgtcctaggtcngcccaggctcgccccctcc

SEQ ID NO: 783700 - DNA, 533 bp, Homo sapiens
  misc_feature: HIJSMM301AXHH4.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactcgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacgttgggtggttcggcggagggaccgaggctggaccgttccgtaggtcacgacccaaggcctcgccccctcggtcactctcgttcccaccctt

SEQ ID NO: 783701 - DNA, 499 bp, Homo sapiens
  misc_feature: HIJSMM301EA9EO.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggcccctgtgttggtgatgtataaagacagtgagaggccctcagggatccctgagcgattctcgtggcgccagctcaggacagtagtcacgttgaccatcagtggagtccaggcagaagacgaggctgactattatgtcagcagtagacagcagtggtccttatcgggtgttcggcgggggacaagctgaccgtcctaggtcagccaggctgccccctcggtccactctcgttccccg

SEQ ID NO: 783702 - DNA, 488 bp, Homo sapiens
  misc_feature: HIJSMM301D9D23.19.71.G05.1.454.light.4.raw
  modified_base (482)..(482): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaataattattaatacttcgttggacgttcggcgaagggaccaaggtgatatnagcgaa

SEQ ID NO: 783703 - DNA, 515 bp, Homo sapiens
  misc_feature: HIJSMM301BD74N.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctcggagcctgaagatgttgcagtttattactgtcaacatcgtaccgagtggcctccgggggccactttcggcccgtgggaccgaaaggtggtagagtacaaacgaaactgtggctgcaccatctgtcttct

SEQ ID NO: 783704 - DNA, 509 bp, Homo sapiens
  misc_feature: HIJSMM301B6H2X.48.73.G07.1.454.light.4.raw
agtatacatacacgaccggtgctcgatttagctctacgctcagggcacgaccggtgctcgatttagtgtcgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacaggacttcactctcaccatcaccagactggagcctgatgtattttgctagtgtttttctgtctagcagtatggaagttcacctcggacattcggcagggaccaaggtggaaagtacaacgaa

SEQ ID NO: 783705 - DNA, 496 bp, Homo sapiens
  misc_feature: HIJSMM301A0EIC.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtacaacaccttcggaccaaggacacgactggagattaaaggaactgtggctgcaccatctgtcttcactcttccccg

SEQ ID NO: 783706 - DNA, 499 bp, Homo sapiens
  misc_feature: HIJSMM301E0N8F.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaactactgttttcggcggtagggaccaagctgaccgtcctaggtcagcccaaggctgccccctcggtcactctcgttcccgccctcctcgagtgcgtct

SEQ ID NO: 783707 - DNA, 420 bp, Homo sapiens; identical to SEQ ID NO: 540533
  misc_feature: HIJSMM301D285T.9.34.D01.1.454.light.4.raw

SEQ ID NO: 783708 - DNA, 515 bp, Homo sapiens
  misc_feature: HIJSMM301DOTIN.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctcgaccgtcctacggtcacgcccaaggcctcgcccccgtcggtccacgttctcgtttccccccg

SEQ ID NO: 783709 - DNA, 521 bp, Homo sapiens
  misc_feature: HIJSMM301C5NKN.19.67.G01.1.454.light.4.raw
tactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcgggcgggagggaccaaggctacggtaccgtccgtacgtcaccgaccgacgtcgtcccgtccccgttccg

SEQ ID NO: 783710 - DNA, 515 bp, Homo sapiens
  misc_feature: HIJSMM301C9RJ5.48.17.B06.1.454.light.4.raw
agtatacatacacgaccggtgctcgatttagtcgatagtgaagggggctggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtagatccggctcttatctgtattttcggcggagggaccaagctcgccgtcctacgtcacgcccaaggctcgccccctcggtccactctcgtt

SEQ ID NO: 783711 - DNA, 501 bp, Homo sapiens
  misc_feature: HIJSMM301EVPAY.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggttctaggcgggactctggggtcccagacagattcagcggcagtgggtcaggcgctgatttcacactgagaatcagcagggtggaggctgaagatgtcggggtttattactgcatgcagggtacagtgtggccttcgctcgcagttcggcggagggaccgaaggtggagatacaaacgaactgtggctcga

SEQ ID NO: 783712 - DNA, 518 bp, Homo sapiens
  misc_feature: HIJSMM301AUU92.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggaggactagaactttgctattcggcggagggaccaagttgaccgtcctaagtcagcccaaggctcgccccctcggtcactctgttccccg

SEQ ID NO: 783713 - DNA, 498 bp, Homo sapiens; identical to SEQ ID NO: 535914
  misc_feature: HIJSMM301APUEY.18.59.F04.1.454.light.4.raw

SEQ ID NO: 783714 - DNA, 506 bp, Homo sapiens; identical to SEQ ID NO: 673942
  misc_feature: HIJSMM301BLGSF.18.59.F04.1.454.light.4.raw

SEQ ID NO: 783715 - DNA, 502 bp, Homo sapiens
  misc_feature: HIJSMM301CTH8R.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggcctcaaacatttcagagagattttcacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctgccccctcggtcta

SEQ ID NO: 783716 - DNA, 505 bp, Homo sapiens
  misc_feature: HIJSMM301CUD93.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtccggccaggttcagtggcagtgggtctgggacagccttcactctcaccatcagcagcctggagcccgaagattttgcggtttattactgtcagcagcgtggccgactggcccctcacgttcggcggagggaccaagggtggacatcaaacgaactgtggctgcaccatctgtcttcatcttcccgc

SEQ ID NO: 783717 - DNA, 489 bp, Homo sapiens
  misc_feature: HIJSMM301AU5GC.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatgtcacgtcccaagaacttttggcgaggggaccaagctggagatacgaaacgaactgtggctgaccaccat

SEQ ID NO: 783718 - DNA, 494 bp, Homo sapiens; identical to SEQ ID NO: 645697
  misc_feature: HIJSMM301DFK2P.47.64.F09.1.454.light.4.raw

SEQ ID NO: 783719 - DNA, 504 bp, Homo sapiens
  misc_feature: HIJSMM301CVYLF.18.59.F04.1.454.light.4.raw
  modified_base (425)..(425): a, c, t, g, unknown or other
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcacgntcatatacaagcagcagcactctaagtcttacggaacgtgggacccgaagttccgaaccgtcctacggtcacgcccgaa

SEQ ID NO: 783720 - DNA, 479 bp, Homo sapiens
  misc_feature: HIJSMM301DZARB.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgcttcccttttgtattggtttctgcagagaggcaggccagtctccacaactcctgatctatgaagttcgccacccggctctctggagtgccagatatgttcagtggctgcggtcaggcacagatctcacactagaaaaacagccgggtaggagagtgacctatgttaggtaacttatactgcatgac

SEQ ID NO: 783721 - DNA, 521 bp, Homo sapiens
  misc_feature: HIJSMM301CCMEB.22.36.D03.1.454.light.4.raw
  modified_base (518)..(518): a, c, t, g, unknown or other
acatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaacccccccaactcatcatttatggtgtcactcgtcggcctcaggagtctctcatcgcttctcaggctccaagtctggcaacacggcctccctaaccatctctgggcctcagtttgaggacgagtctacttattactgctagttcctttaaaattaggcgccactcttcgttggttttcggcggtaggcaccgaagtcgaccgtcctcggtcagcccaaggcctgccccctcgtcnctc

SEQ ID NO: 783722 - DNA, 485 bp, Homo sapiens
  misc_feature: HIJSMM301EWV4I.9.76.G10.1.454.light.4.raw
tgatacgtctcacgaccggtgctcgatttagtcactcatacaggggggggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctcccaaactcctcatctattatgatgatctgcttgccctcaggggtctctgaccgattctctggctccaagtctggcaccctcagcctccctggccatcagtgggctccagtctgaggatgaggctgattattactgtggagcatgggatgacagcctgaatgcttggatgttcggcggagggaccaagctgaccgtcctacggtcacgcccaac

SEQ ID NO: 783723 - DNA, 508 bp, Homo sapiens
  misc_feature: HIJSMM301DQC1T.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattattgggtgttcggcggagggaccaagctgaccgtcctgcgtcagcccaaggctcgccccctcggtc

SEQ ID NO: 783724 - DNA, 518 bp, Homo sapiens
  misc_feature: HIJSMM301ARMZR.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgctactctactttggtggtgctgtgctattcggcggagggaccgaagctgaccggtcttaagtacacgcccaaggctgcccccctccggtcactctgttcccaccctcct

SEQ ID NO: 783725 - DNA, 495 bp, Homo sapiens
  misc_feature: HIJSMM301B9F1E.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagaataaaggaactgtagctgcaccatctgtcttcactcttccccg

SEQ ID NO: 783726 - DNA, 506 bp, Homo sapiens
  misc_feature: HIJSMM301A2GLF.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctccctgctactctggctcccagagatcattgggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccgaaggtggacctcaaacgaactgtggctgcaccatctgtcttcatctcccgc

SEQ ID NO: 783727 - DNA, 485 bp, Homo sapiens
  misc_feature: HIJSMM301DXAM3.16.86.H09.1.454.light.4.raw
  modified_base (415)..(415): a, c, t, g, unknown or other
tgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggccctccctgaccatctctggggctccaggctgaggacgaggctgattattattgcatctcatataacaaccaacagcactctcgactggtattcggcggagggaccaagcngaccgtcctaggtcagcccaaggctcgccccctcggtccactcctgttcccgccctcctcgagtagtaca

SEQ ID NO: 783728 - DNA, 512 bp, Homo sapiens
  misc_feature: HIJSMM301EK6CL.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgattcttcgggcggggggaccaagctgaccgtcctaggtcacgcccaaggctcgtccccccg

SEQ ID NO: 783729 - DNA, 498 bp, Homo sapiens
  misc_feature: HIJSMM301EQYBW.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagtatttttctctcgtcatcactggtctacagtctgacgacggcgcaatgtacttctgtacaacactatcgcctcctcccccctacaagtttcggtcaggggaccaagttagaacatcaatcgaactgtggctgcaccatctgtctt

SEQ ID NO: 783730 - DNA, 507 bp, Homo sapiens
  misc_feature: HIJSMM301DEJFE.41.53.E09.1.454.light.4.raw
tctatactatcacgaccggtgctcgatttagagagagtgtgttgggtttggggtggggtctcaggaggcagcgctctcgggacgtctccaccatggcctgggctctgctattcctcaccctcctcactcagggcacagggtcctgggcccagtctgccctgactcggcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcgggacggagggaccaaggctgaccgttccgtaggtccagacccaaggctccg

SEQ ID NO: 783731 - DNA, 509 bp, Homo sapiens
  misc_feature: HIJSMM301BDP9L.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaatctggcaacacggcctccctgaccatctctggctcgagtctgaggacgaggctgattacttctgttgctcttgggcaactactgtcgtttgggtgttcggcggaggaccaagttgaccgtcctaggttcacgcccaaggctgccccctcggtcactctcgtt

SEQ ID NO: 783732 - DNA, 447 bp, Homo sapiens
  misc_feature: HIJSMM301C1UGG.18.9.A09.1.454.light.4.raw
tacgagtatgcacgaccggtgctcgatttagcgagacgcgcagggtcctgggcccagtctgtgctgacgcagccaccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 783733 - DNA, 528 bp, Homo sapiens
  misc_feature: HIJSMM301D9FZ6.41.25.C03.1.454.light.4.raw
tctatactatcacgaccggtgctcgatttagtagtgtagatttgggtttggggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctggaagagtgaggacgaggctgactacttctgtcagtcttatgatataaactaattatgtgataattggacggagggaccgagggtcgaccgtcctaggtcacgcccaaggctcgccccctcggtcactctcgttcccta

SEQ ID NO: 783734 - DNA, 496 bp, Homo sapiens
  misc_feature: HIJSMM301D518N.8.12.B01.1.454.light.4.raw
  modified_base (394)..(394): a, c, t, g, unknown or other
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggcctccaactctgggaacacagccactctgaccatcagcgggacccaggctacggatgaggcngactattactgtcaggcgtgggacagcagcacctatcgttggttttcggcggagggaccaagctcgaccgtccgttggtcagcccaacggctcgtccccccg

SEQ ID NO: 783735 - DNA, 495 bp, Homo sapiens; identical to SEQ ID NO: 574296
  misc_feature: HIJSMM301EOVJE.15.71.G05.1.454.light.4.raw

SEQ ID NO: 783736 - DNA, 484 bp, Homo sapiens
  misc_feature: HIJSMM301BQ7QS.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtgggtcccatcgcggttcagcggcagtggatatgggacatatttcactctcgccatcagcagcctgcagcctgaagattttgctaacttactattgtcaacaggactaacacgtttcccgctcaccttccgggcgggggaccgaaggtggagatacaaacgaactagtggctgcac

SEQ ID NO: 783737 - DNA, 502 bp, Homo sapiens
  misc_feature: HIJSMM301AWR9E.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtatgggacagagttcactctcaccatcagcagcctgcagtctgaagattttgctagttttttactgttcagcagtatagtaactggcctccgtactacttttcggccgaggggaccaagctaagaaatccaaacgaactgtggctgcaccatctgtcttcta

SEQ ID NO: 783738 - DNA, 538 bp, Homo sapiens
  misc_feature: HIJSMM301C4DVI.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaattgttacgtttttcgggacgggtacgggaccaaagcgtcgtaccggtccgtcggggttccaacggccccgaaggtccctcggtcccccctccgggtccta

SEQ ID NO: 783739 - DNA, 495 bp, Homo sapiens
  misc_feature: HIJSMM301C93R5.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatccagcagcctagagcctgaagactttggacttttattactgtcagcagcgtgagttctggcctccgctcactttcggcggagggaccagggtggagatcaaacgaactgtggctgcacatctgtcttcatcc

SEQ ID NO: 783740 - DNA, 454 bp, Homo sapiens
  misc_feature: HIJSMM301DHPWN.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggccaagctgaccgtcctaagtcagcccaaggctgccccctcggtcactctgttcccaccctcctccacgacgagta

SEQ ID NO: 783741 - DNA, 492 bp, Homo sapiens
  misc_feature: HIJSMM301EP514.8.53.E09.1.454.light.4.raw
ctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggcctcaggggtctctgaccgattctctgcctccaagtctggcacttctgcctcctggtcatatctgtctccgaggtgaggatgaggctgtattattactcgccaactcctatcgaacaacacgcctgagtatttggctggttcggcggcgggacctaacgttc

SEQ ID NO: 783742 - DNA, 503 bp, Homo sapiens
  misc_feature: HIJSMM301CJ0TO.22.14.B03.1.454.light.4.raw
  modified_base (480)..(480): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtcctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtcctgaccgattcagtggcagcgggtctgggacagatttcactctcaccatcagcagcctgcaggctgaagatgtggcagtttattattgtcagcaatattatattcctccttcagaacgttcggccaagggaccgaaggtggaaagtnaaacgaactagtgcgtgctacca

SEQ ID NO: 783743 - DNA, 522 bp, Homo sapiens
  misc_feature: HIJSMM301DRAX8.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtccccaggcagcgctggcccctgctgctgctgggctggccatggtcgcccatggcctgctgcgcccaatggttgcacgcaaagcggggacccagaccctggagcctcagttgaagcagccgatccagcctgcggagcctgtcgggcaggtcaggcccaaaggcccaacccccactcgtcactcttcg

SEQ ID NO: 783744 - DNA, 493 bp, Homo sapiens
  misc_feature: HIJSMM301DZXKJ.17.25.C03.1.454.light.4.raw
cgtagactagcacgaccggtgctcgatttagtagtgtagatttggggtttgggggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaaacctatttaaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggctaggggaccaaagtgagatcaaacgaactgtaggctgcacatctgtt

SEQ ID NO: 783745 - DNA, 499 bp, Homo sapiens
  misc_feature: HIJSMM301AGQ66.41.53.E09.1.454.light.4.raw
tctatactatcacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacagcagcagcactctcgtggtattcgggcggaggaccaagctgaccgtcctaggtcacgcccaaggctcg

SEQ ID NO: 783746 - DNA, 522 bp, Homo sapiens; identical to SEQ ID NO: 561516
  misc_feature: HIJSMM301CKTIR.27.23.C01.1.454.light.4.raw

SEQ ID NO: 783747 - DNA, 523 bp, Homo sapiens
  misc_feature: HIJSMM301EAWSA.48.41.D08.1.454.light.4.raw
agtatacatacacgaccggtgctcgatttagtcacgcgagaaagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctcgccccctcggtcactctgttccccgccctt

SEQ ID NO: 783748 - DNA, 502 bp, Homo sapiens
  misc_feature: HIJSMM301C1UFE.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcaggcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcactccttcccgccatctgacta

SEQ ID NO: 783749 - DNA, 446 bp, Homo sapiens
  misc_feature: HIJSMM301DA8HK.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagccctgaggatgaggctgattattactgtcagttcctttgacattaaactggatggtggtattcgggcggagggacccacgtaaccgtcctaggtcagcccaaggctgccccctcggtcactctcgttcccaccctcctcgtatctctcg

SEQ ID NO: 783750 - DNA, 503 bp, Homo sapiens
  misc_feature: HIJSMM301CTIQS.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatgaggccgactactactgtcaggtgtgggatttcactactgatcatgtggggtcttcggcggagggaccaagctgaccgtcctaagtcagcccaaggctcgccccctcggtct

SEQ ID NO: 783751 - DNA, 499 bp, Homo sapiens
  misc_feature: HIJSMM301BWZBG.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttatttttgtcagcaatattatcatactccgctcactttcggcggagggaccaaggtggagatcaaacgaacctgtggctgcacc

SEQ ID NO: 783752 - DNA, 488 bp, Homo sapiens
  misc_feature: HIJSMM301AURHZ.46.35.D02.1.454.light.4.raw
actagcagtacacgaccggtgctcgatttagcacacgatagttggggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccaggggaccaagctggagatcaaacgaactgtaggctgcacat

SEQ ID NO: 783753 - DNA, 530 bp, Homo sapiens
  misc_feature: HIJSMM301AN2BP.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagccccaaactcatgatttatgaagtcagtaatcggccctcaggggtccctgatcgcttctctgggtccaagtctggcaacacggcctccctgaccatctctgggctccaggctgaggacgaggctgattattactgcagtcttatatacaggcaacaatacttttgtcttcggacgtaggaccaaggtacaccgtcctacggtcgacgcccgaacggcccgaaaccccctacctacgtccacttcccttcg

SEQ ID NO: 783754 - DNA, 477 bp, Homo sapiens
  misc_feature: HIJSMM301CU364.5.70.G04.1.454.light.4.raw
  modified_base (310)..(310): a, c, t, g, unknown or other
  modified_base (353)..(353): a, c, t, g, unknown or other
atcagacacgcacgaccggtgctcgatttagtgtagtgtgaaggggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagngtgggtcccatcaaggttcatcggcagtggatctgggacaagntttcactctcaccatcagcagcctgcagcctgaagatttgctaacttacttttgtcactaggctcagtagttcccgctcgactttcggcggacggaaccagggtcgaagatacaaacgaactgt

SEQ ID NO: 783755 - DNA, 527 bp, Homo sapiens
  misc_feature: HIJSMM301CC84A.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacggaggctgagtattactgtctgctccactttcgtactgcctgggtcgttcggcgggggactcagttgaccgtcctggtcacgcccaaggcctcgccccctccggtcactcctcgttcccgccctccctcctacta

SEQ ID NO: 783756 - DNA, 507 bp, Homo sapiens
  misc_feature: HIJSMM301DJZXJ.40.67.G01.1.454.light.4.raw
  modified_base (434)..(434): a, c, t, g, unknown or other
tctagcgactcacgaccggtgctcgatttagagtatacatattgggtttggggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcaggcgtgccgactggccccctnaccgttcggcggagggaccaaggtggacatcaaacgactgtggctgcaccatctgtcttcatcttcccgccat

SEQ ID NO: 783757 - DNA, 486 bp, Homo sapiens
  misc_feature: HIJSMM301EYROV.13.71.G05.1.454.light.4.raw
tcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctgtggatgaggctgactattactgtcaggcgtgggacagcagcactgcctccttacggaactgggaccaaggtccaccgtcctaggtcacgacccaggacccaaccccg

SEQ ID NO: 783758 - DNA, 484 bp, Homo sapiens
  misc_feature: HIJSMM301C5RWN.17.50.E06.1.454.light.4.raw
cgtagactagcacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcaggccattagcagctatttaaattggtatcagcagaaaccagggaaagcccctaagctcctgatctatgctgcatccagtttgcaagtgggtcccattaaggttcagtggcagtggatctgggacagatttcactctcacatcagcagtctgcaacctgaagtattttgctaacttactcctgtcaacagtagttactacgtaccccgttctacgttttggccgaggggaccaagcgtggagatacaaacgaacgt

SEQ ID NO: 783759 - DNA, 494 bp, Homo sapiens
  misc_feature: HIJSMM301BV9B9.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcaagaaaccaggacagcctcctaagctgctcatttaccgggcagcgtacccgggaatccggggtccctgagcgattcagtggcaggcggtcgtgggacagatttcactctcaccatcagcagcctgcaggtctgaagatgtggctagtttattactgtcagcaatattctactacctcctcggactttcggcggagggaccgaaggtggagatacaaacgaa

SEQ ID NO: 783760 - DNA, 499 bp, Homo sapiens; identical to SEQ ID NO: 536578
  misc_feature: HIJSMM301DQXB7.22.27.C05.1.454.light.4.raw

SEQ ID NO: 783761 - DNA, 490 bp, Homo sapiens
  misc_feature: HIJSMM301DTTP4.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatcgtgggacagagttcactctcaccatcagcagcctgcagcctagaagatgtgctaacttattactgtacaaaagttataacagtccgccccctttcaccctttcggaccaaggggacacgactacggagtattaggaaccg

SEQ ID NO: 783762 - DNA, 514 bp, Homo sapiens
  misc_feature: HIJSMM301AG80E.48.30.C08.1.454.light.4.raw
  modified_base (377)..(377): a, c, t, g, unknown or other
agtatacatacacgaccggtgctcgatttagtctgacgtcaaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttacnctcaccatcagtagcctgcaggctagaagatgtggctagtttattactgtcaacaatattattatactccgccgacgtcggtccgggggaccaacggtggaaatactaaacgaaactgtggcgtgcaccactctgtt

SEQ ID NO: 783763 - DNA, 505 bp, Homo sapiens
  misc_feature: HIJSMM301D8NSX.21.87.H10.1.454.light.4.raw
  modified_base (322)..(322): a, c, t, g, unknown or other
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgtttttaaccttgtctcctggtatcaacaacaccaggacaaggccccaaaactcttaatttctggcgtcaatcagcgaccctnacatgtttccagtcgattctctgcatccaagtctggcaacacggcctttctgacaatctctcaactccaggctgaagacgaggctatttattactgctcctcatacgcaggtggcacatttttcttggtttttggcggcgggaccagatgactgtcctcagtcagccaaggctgccccctggt

SEQ ID NO: 783764 - DNA, 505 bp, Homo sapiens
  misc_feature: HIJSMM301EBJYK.40.59.F04.1.454.light.4.raw
tctagcgactcacgaccggtgctcgatttagtacacacacttagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcaggtgtaggtgggtttttcgggcgggacggggaccgaaagcgtacggaccggtacctaacgtcgacggacccaagggtccg

SEQ ID NO: 783765 - DNA, 486 bp, Homo sapiens
  misc_feature: HIJSMM301DL2M3.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaattatgcttattggtaccaacaaaagccaggccaggcccctgtggtggtgatataataaagacaagtgagaggccctcagggatccctgagcgattctctggctccagctcagggacaacagtcacgttgaccatcagtggagtccaggcagaggacgaggactgactattattgtcaatcagcagacaacagtaatacttatcttttatgtcttgatctgggaccaggtcaccgtctaggtcagcccaaggccaaccc

SEQ ID NO: 783766 - DNA, 490 bp, Homo sapiens
  misc_feature: HIJSMM301EAB9P.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcactctatgctgcatccatcagggccactggcatcccaggcagattcagtggcagtgggtctgggacagacttcactctcaccatcagcagactggagcctgaagatttttgctagtctattactgtcagcagtatggtcacgtcccaagtaactttggaccaggggaccaagctggagatcaaacgaactgtggctgcaccat

SEQ ID NO: 783767 - DNA, 509 bp, Homo sapiens
  misc_feature: HIJSMM301BV66F.10.27.C05.1.454.light.4.raw
catagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagccggccctcgaggggtttctagtcgcttctctgcctccaagtctggcaacacggcctccctgacaatctctgggctccaggctgacgacgaggctgaatattactgcagctcatatgtagatggtgcctcttttctaagggttttcggcggtagggaccaggctgccgtctaagtcagccaagctcgcccctcggt

SEQ ID NO: 783768 - DNA, 517 bp, Homo sapiens
  misc_feature: HIJSMM301C2P13.18.78.H01.1.454.light.4.raw
  modified_base (476)..(476): a, c, t, g, unknown or other
tacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgctagctcatatacaaagacagacagcactccaagtcttcggaactcgggaccaacggtnaccgtacccaggtcaagccaacggccaacccccactatcta

SEQ ID NO: 783769 - DNA, 519 bp, Homo sapiens
  misc_feature: HIJSMM301CDMTH.16.66.F11.1.454.light.4.raw
  modified_base (508)..(508): a, c, t, g, unknown or other
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagccgcccgggcagtcgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctcgccccctcggtcactctgttccccacccttccncgagtagtaca

SEQ ID NO: 783770 - DNA, 517 bp, Homo sapiens
  misc_feature: HIJSMM301B52B0.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaaacatccggccctcagggatcccagaccgattctctggctccaactcaggaaacacagcttccttgaccatcactggggctcaggcgaagatgaggctgactattactgtaattcccgggacagcagtgctaaaccccaattatgtcttcggaactcgggacaaggtcaccgtcctaggtcagcccaaggcccacccac

SEQ ID NO: 783771 - DNA, 509 bp, Homo sapiens
  misc_feature: HIJSMM301EQFF0.48.36.D03.1.454.light.4.raw
agtatacatacacgaccggtgctcgatttagctgcgtcacgatctctcttgggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttctattttctaagtttcctttttgttcttcggaactgggaccgaggtccaccgtcctaggtcagcccaaggccaaccccactgtcta

SEQ ID NO: 783772 - DNA, 488 bp, Homo sapiens
  misc_feature: HIJSMM301AUH2D.19.71.G05.1.454.light.4.raw
  modified_base (277)..(277): a, c, t, g, unknown or other
  modified_base (483)..(483): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcaganaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccgaggtaggatatcanacgaa

SEQ ID NO: 783773 - DNA, 508 bp, Homo sapiens
  misc_feature: HIJSMM301AKO0P.7.1.A01.1.454.light.4.raw
cgtgtctctacacgaccggtgctcgatttagacgtctcatcaaggaagggaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaacccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgacaacagtgatctagttcggcggagggaccaagctgaccgtctaggtcagcccaaggctcgccccctc

SEQ ID NO: 783774 - DNA, 514 bp, Homo sapiens
  misc_feature: HIJSMM301DU94U.16.66.F11.1.454.light.4.raw
  modified_base (47)..(47): a, c, t, g, unknown or other
tgtactactccacgaccggtgctcgatttagtcacgcgagaagggtnagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtagtaca

SEQ ID NO: 783775 - DNA, 519 bp, Homo sapiens
  misc_feature: HIJSMM301D5L10.48.17.B06.1.454.light.4.raw
  modified_base (505)..(505): a, c, t, g, unknown or other
agtatacatacacgaccggtgctcgatttagtcgatagtgaaggggggggtcgacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatcggctcttatctgattttcggcggagggaccaagctgaccgtcctacgtcagcccaaggctgccccctcggtcactcncgtttcccaccctt

SEQ ID NO: 783776 - DNA, 508 bp, Homo sapiens; identical to SEQ ID NO: 730568
  misc_feature: HIJSMM301A32MM.18.78.H01.1.454.light.4.raw

SEQ ID NO: 783777 - DNA, 354 bp, Homo sapiens; identical to SEQ ID NO: 535026
  misc_feature: HIJSMM301CXM6H.19.22.B11.1.454.light.4.raw

SEQ ID NO: 783778 - DNA, 509 bp, Homo sapiens
  misc_feature: HIJSMM301CDLR9.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctggctccaggctgaggatgaggctgattattactgctactcatatgcaggcggcaactcgttgggtgttcggcggagggaccaagctgaccgtcctacggtcacgccaggctcgccccctcggtcctactctccg

SEQ ID NO: 783779 - DNA, 515 bp, Homo sapiens
  misc_feature: HIJSMM301EWPUL.16.66.F11.1.454.light.4.raw
  modified_base (186)..(186): a, c, t, g, unknown or other
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccanctcctgcacccgcagcagtggcacctttgccggctattatgtgcagtggttccagcagcgcccgggcagtgcccccaccacgagtgatctatgaggataacctacggccctctggggtccctcctcggttttctggctccatcgacgggtcctccactactgcctccctcaccatctctggactgaagactgaggacgaggctgactactactgtcagtcttatgataacaccagggtgtgttcggcggagggaccaagctggccgtcctaggtcagcccaaggctgccccctcggtcactctgttcccgcccttcctcgagtagtaca

SEQ ID NO: 783780 - DNA, 502 bp, Homo sapiens
  misc_feature: HIJSMM301AGX6C.49.45.E01.1.454.light.4.raw
agtcgagagacacgaccggtgctcgatttagtgagtcagtaagggaaagggggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggctttgatgtccactggtaccagcagcttccaggaacagcccccaaactcctcatctatggtaacaacaatcgccctcagggtccctgaccgattctctgcctccaagtctgccacctccggcctccctggccatcactgggctccaggctgaagatgaggctgattattactgccagtccctatgacacgcaccatgagtccgttccgtcggtcttcggcggacgggacccaggctgaccgtcctacggtcacgcccaacggccg

SEQ ID NO: 783781 - DNA, 504 bp, Homo sapiens
  misc_feature: HIJSMM301AY0FI.2.76.G10.1.454.light.4.raw
acgctcgacacacgaccggtgctcgatttagtcactcatacagggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtcttggtc

SEQ ID NO: 783782 - DNA, 377 bp, Homo sapiens
  misc_feature: HIJSMM301B9WIG.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactgggcgtcttcccgggagtccggggtccctgaccgattcagtgccagcgggtctgggacagacttcactcctcacca

SEQ ID NO: 783783 - DNA, 498 bp, Homo sapiens; identical to SEQ ID NO: 655308
  misc_feature: HIJSMM301AMAMJ.40.87.H10.1.454.light.4.raw

SEQ ID NO: 783784 - DNA, 508 bp, Homo sapiens
  misc_feature: HIJSMM301ATJHF.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttccctctttcaagatattcggcggaagggaccaggctgaccgtcctgagtcagcccaaggctcgtccccccg

SEQ ID NO: 783785 - DNA, 528 bp, Homo sapiens
  misc_feature: HIJSMM301D99AP.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaaccctccatctgacgatgaggctgagtatcactgtggagagagccacacaaattgatggccaagacggttgggtgttcggcggagggaccaagctgaccgtcctaggcagcccaaggcctgcccccccgtaggtccaccgtcttcgttccccacccgtccctcgctacgtagacg

SEQ ID NO: 783786 - DNA, 509 bp, Homo sapiens
  misc_feature: HIJSMM301AQI4L.13.81.H04.1.454.light.4.raw
tcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctcctgaccatctctgggctccaggcagaggacgaggctgattattactgcggctcctggacgattagcaccctttatgtcttcgggactgtgaccaaggtcacgtcctaggtcagcccaagccaacccactgtcactctgtcccta

SEQ ID NO: 783787 - DNA, 495 bp, Homo sapiens
  misc_feature: HIJSMM301EO0YP.18.59.F04.1.454.light.4.raw
  modified_base (426)..(426): a, c, t, g, unknown or other
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctnattatacaagcaccagcactctctatgtcttcggaactggaccaaggtcaccgtctaggtcagccaagg

SEQ ID NO: 783788 - DNA, 507 bp, Homo sapiens
  misc_feature: HIJSMM301D4QBN.48.34.D01.1.454.light.4.raw
  modified_base (432)..(432): a, c, t, g, unknown or other
  modified_base (474)..(474): a, c, t, g, unknown or other
agtatacatacacgaccggtgctcgatttagatcgtctgtgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggccaaagcccccaaaagtcatgatttatgaggtcagtaagcggccctcaggggtccctgatcgctctctggctcaagtctggcaacacggcctccctgaccgtctctgggctccaggctgaggatgaggctgattattaactgcagctcatatncaggcagcaacaatgtaggtattcggcgacgggacaagactnaccggtcctaaggtctacgacccaaggcctccg

SEQ ID NO: 783789 - DNA, 499 bp, Homo sapiens
  misc_feature: HIJSMM301BLFMD.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgtcggtttattactgtcagcagtataataactggcctccacgtacacttttggccaggggaccaagctggagatacaaacgaactagtggctgcaccatctgtt

SEQ ID NO: 783790 - DNA, 515 bp, Homo sapiens
  misc_feature: HIJSMM301ATI5O.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacaccccaggcaaagcccccaaactcataatttatgacgtcaatgttcgcccctcaggggtttctcatcgcttctctggctccaaatctggcaacacggcctccctgaccatctctgggctcgagtctgaggacgaggctgatttacttctgttgctcttgggcaactactgtcgtttgggtgttcggcggagggaccaagttcgaccgtcctaggtcagcccgaaggctcgccccctcggtctactctgtt

SEQ ID NO: 783791 - DNA, 515 bp, Homo sapiens
  misc_feature: HIJSMM301EJT0N.9.21.B10.1.454.light.4.raw
tgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctcgcctccaagtctggcaacacggcctccctgacaatctctgggctccagtctgacgacgaggctgattattactgcagctcatatgcagttggttcctctttcaagtatattcggcggagggaccaggctcgaccggttcctgtagtcacgccctaaggcttcgccccccg

SEQ ID NO: 783792 - DNA, 406 bp, Homo sapiens
  misc_feature: HIJSMM301DJOBW.7.27.C05.1.454.light.4.raw
cgtgtctctacacgaccggtgctcgatttagacgcgatcgaagggtttggggccccagggcagagggtcaccatctcctgcactgggaacgcctccaacatcgggacttttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctgccccctcggtcactctgttcccaccctcctctagagacacg

SEQ ID NO: 783793 - DNA, 501 bp, Homo sapiens; identical to SEQ ID NO: 639661
  misc_feature: HIJSMM301AQ8LC.21.81.H04.1.454.light.4.raw

SEQ ID NO: 783794 - DNA, 483 bp, Homo sapiens
  misc_feature: HIJSMM301CBF4H.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgctaacttattactgtctacaagattacaattaccctcggacgttcggaccgagggaccgaggtaggaatacaacgactagtgctg

SEQ ID NO: 783795 - DNA, 507 bp, Homo sapiens
  misc_feature: HIJSMM301AZ051.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaaataatgaatatgtctcctggtaccaacagtacccaggcaaacgcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcggggggaccacactcgaccgtcctaggtcagcccaaggcctcgccccgtcggtcactctcgttccccgccctcctccactactatg

SEQ ID NO: 783796 - DNA, 489 bp, Homo sapiens
  misc_feature: HIJSMM301EWGAF.48.34.D01.1.454.light.4.raw
agtatacatacacgaccggtgctcgatttagatcgtctgtgttggggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccagggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgagattttgcagtgtattactgtcagcagtatggtagctcacctcaactcactttcggcggagggaccaaggtggagatcaaacgaactgtggctgca

SEQ ID NO: 783797 - DNA, 497 bp, Homo sapiens
  misc_feature: HIJSMM301DDKDL.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcacgcctgcagtctgaagtattttgctagtttattactgtcagcactataataactcggcctccgtactaggttttcggaccgtaggggacccaacggctgggagactacaaacgaac

SEQ ID NO: 783798 - DNA, 516 bp, Homo sapiens
  misc_feature: HIJSMM301BD23Z.52.77.G11.1.454.light.4.raw
cgcagtacgacacgaccggtgctcgatttagctagtcactcaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggcctcgccccctcggtcactcttccg

SEQ ID NO: 783799 - DNA, 527 bp, Homo sapiens
  misc_feature: HIJSMM301D7ZPX.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggcggagggaccaggctggaccgtcctaggtcagcccaaggctcgccccctcggtcactcctgttccccacct

SEQ ID NO: 783800 - DNA, 478 bp, Homo sapiens
  misc_feature: HIJSMM301EZN9Q.46.26.C04.1.454.light.4.raw
  modified_base (55)..(55): a, c, t, g, unknown or other
actagcagtacacgaccggtgctcgatttagtctagcgactttgggtttggggtnatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctggagatgttgggctctattattgcatggcaagctctacgaagtcccgctcactttcggcggagggaccaaggtggagat

SEQ ID NO: 783801 - DNA, 507 bp, Homo sapiens
  misc_feature: HIJSMM301EBOWH.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggaggaccaagctgaccgtcctaggtcacgccaaggctcgccccctcggt

SEQ ID NO: 783802 - DNA, 500 bp, Homo sapiens
  misc_feature: HIJSMM301CLBI8.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaaagcccccaaactcatgatttatgatgtcagtaatcggccctcaggggtttctaatcgcttctctggctccaagtctggcaacacggcctccctgaccatctctgggctccaggctgaggacgaggctgatttattactgcagctcatatacaagcagcagcactcaagtcttcggaactgggaccaaggtcaccgtctaggcagcccaaggcccaaccca

SEQ ID NO: 783803 - DNA, 523 bp, Homo sapiens
  misc_feature: HIJSMM301CEXYA.10.28.C06.1.454.light.4.raw
  modified_base (300)..(300): a, c, t, g, unknown or other
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggcaaagcccccaaactgatgatttangatgtcagtaatcgaccctcaggggtttctgatcgcttcttgcctccaagtctggcaacacggcctccctgaccatctctgggctccagactgaggacgaggctgattattactgcagctcacatacaaagcggcagcggttgggtggttcggtcgggggaccacgactgaccgtacctaggtcagcccaaggctgccccctcggtccactctgttccccccg

SEQ ID NO: 783804 - DNA, 523 bp, Homo sapiens
  misc_feature: HIJSMM301A6XED.40.74.G08.1.454.light.4.raw
  modified_base (210)..(210): a, c, t, g, unknown or other
  modified_base (512)..(512): a, c, t, g, unknown or other
tctagcgactcacgaccggtgctcgatttagtagctctatcaggggggggggaagctcagcttcagctgtgggtagagaagacaggactcaggacaatctccagcatggccagcttccctctcctcctcaccctcctcactcactgtgcagggtcctgggcccagtctgtcctgactcagccaccctcagcgtctcggggacccccgggnagacggtgaccatctcctgttctggaagcagttccaacatcggaagtaataatgtgaattggtaccggcaactccccaggaacggcccccaaactcctcatacatagtaatgatcatcggccccctggggtccctgaccgaatctctggctccaggtctggcgcctcagcctccctggtcattagtgggctccagtctgacgatgaggctgactatttactgttcagcgtgggatggccagcccgaatcattgggtgttcggcggagggaccaaactgaccgtcctaggtcagcccaaggcncgcccctcggt

SEQ ID NO: 783805 - DNA, 500 bp, Homo sapiens
  misc_feature: HIJSMM301DNSVV.51.26.C04.1.454.light.4.raw
  modified_base (492)..(492): a, c, t, g, unknown or other
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgatttcggcggagggccagtctgaccgtcctaggtcagccaaggctcgccccctcgtaccnctcttccg

SEQ ID NO: 783806 - DNA, 468 bp, Homo sapiens
  misc_feature: HIJSMM301AK3TK.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagcccaggttcagtggcagtgagtctgggacagacttcactctcaccatcagcagcctagagcctgaagattttgctactttattactgtcagcagcgtagcaactggcctctctactttcggcggagggaccagggtggagatcagacgaactgtggctgcaccatctgtcttcatcttccccgctatctgaagtatagtct

SEQ ID NO: 783807 - DNA, 486 bp, Homo sapiens
  misc_feature: HIJSMM301BFWBC.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgcctcaccttcggccaagggacacgactggagattaaacgaactgtggctgcaccat

SEQ ID NO: 783808 - DNA, 463 bp, Homo sapiens
  misc_feature: HIJSMM301CHOWD.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgctaacttattactgtacaaaagtataacagtcgacccccttcaccttcggccaagggacacga

SEQ ID NO: 783809 - DNA, 509 bp, Homo sapiens
  misc_feature: HIJSMM301DOTR1.8.42.D09.1.454.light.4.raw
ctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattaattactgcagctcatattcaggcagcaacagggtattcggcggagggaccaagttgaccgtcctaggtcacgcccaaggctcgcccccgtcggtccactctcgtt

SEQ ID NO: 783810 - DNA, 524 bp, Homo sapiens
  misc_feature: HIJSMM301AZ0Y8.9.86.H09.1.454.light.4.raw
tgatacgtctcacgaccggtgctcgatttagtgctatagacttgggtttggggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggaggaccaagctgaccgtcctaggtcagcccaaggctgccccctcggtccactctcgttcccaccctcctccg

SEQ ID NO: 783811 - DNA, 479 bp, Homo sapiens
  misc_feature: HIJSMM301AFZC9.22.29.C07.1.454.light.4.raw
acatacgcgtcacgaccggtgctcgatttagagtgctacgaagggaaagggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagtattttgctagtttattactgtcagcagtataattactggcctcggacgttcggccgacggaccgaggtaggagtacaacgaactagtgg

SEQ ID NO: 783812 - DNA, 501 bp, Homo sapiens
  misc_feature: HIJSMM301C7ECP.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggctagtttattactgtcagcaatattatattcctcctcagtacgttcggaccgaagggaccaaggtggaaatacaaacgaactgtggctgcacc

SEQ ID NO: 783813 - DNA, 523 bp, Homo sapiens
  misc_feature: HIJSMM301DWLU7.5.24.C02.1.454.light.4.raw
atcagacacgcacgaccggtgctcgatttagtacagatcgttaggggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatggtctcctggtaccaacaacacccgacaaagcccccaaactcatcatttttgaggtcactacgcgacctcaggggtccctgatcgcttctctgactccaagtctggcaacacggcctcctgaccgtctctgggctccaggctgaggatgaggctgattattactgctagctcatatgcaggcagcagcagtccccaatgtgtatcgttcgggcggggggaccgaaaggctgacccggtcctaggtcctaggacccaaggcgtcgtccccccg

SEQ ID NO: 783814 - DNA, 499 bp, Homo sapiens
  misc_feature: HIJSMM301ANPZS.4.27.C05.1.454.light.4.raw
agcactgtagcacgaccggtgctcgatttagacgcgatcgaaggggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtggacatgggcactgcatcttcggcggagggaccaagctgaccgtcctgggtcagcccaaggcctcgccccctcggtcacttccg

SEQ ID NO: 783815 - DNA, 494 bp, Homo sapiens
  misc_feature: HIJSMM301AOKXR.26.78.H01.1.454.light.4.raw
  modified_base (448)..(448): a, c, t, g, unknown or other
  modified_base (485)..(485): a, c, t, g, unknown or other
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagccctgaagattttgcactttatttactgtcagcagcgtagcaactggcctctcactttcggcggngggaccgagggtggagatcagacgaactgtggctgcnccatctgtt

SEQ ID NO: 783816 - DNA, 507 bp, Homo sapiens; identical to SEQ ID NO: 538702
  misc_feature: HIJSMM301AHHLO.11.57.F02.1.454.light.4.raw

SEQ ID NO: 783817 - DNA, 513 bp, Homo sapiens
  misc_feature: HIJSMM301D1O04.43.67.G01.1.454.light.4.raw
tgtgagtagtcacgaccggtgctcgatttagagtatacatattgtgggcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttactgggatctacccgggaatccggggtcctgaccgattccgtggcagcgggtctgggacagacttcactctcaccatcagtagcctgcagcctgaagatgtggcaacttatactgtcaacaatttcgttatacctccgccgacggttcggtcccgggggaccacccggt

SEQ ID NO: 783818 - DNA, 525 bp, Homo sapiens
  misc_feature: HIJSMM301CR3ZB.5.58.F03.1.454.light.4.raw
atcagacacgcacgaccggtgctcgatttagtctgatcgagaaggggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttataaccttgtctcctggtaccaacagcaaccaggcaaagccccctaaacttttggtttatcagggcaataagccggccctcaggggtttctaatcgcttctctggctccaagtctggcaacacggccgccctgacaatctctaggctccaggctgacgacgaggctgtatttttactgctgctcatatgcaggttgatcactacttttatgttcgggactgggaccaaggtccaccgtcctaggtcacgcccaaggcccaaccccactgtccactcttccg

SEQ ID NO: 783819 - DNA, 500 bp, Homo sapiens
  misc_feature: HIJSMM301EXPMA.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtgggacgttcggccaagggaccaaggtggaaatacaaacgaactgtggctgcacc

SEQ ID NO: 783820 - DNA, 490 bp, Homo sapiens
  misc_feature: HIJSMM301CVSN2.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtcctgaccgattcagtggcagcgggtctgggacagatttcactctcaccatcagcagcctgcaggctagaagatgtggctagtttattattgtacaacaatattattatacttcgtggacgttcggccaagggaccgaaggtggagtatcagacgaa

SEQ ID NO: 783821 - DNA, 494 bp, Homo sapiens
  misc_feature: HIJSMM301EZ75A.12.27.C05.1.454.light.4.raw
atacgacgtacacgaccggtgctcgatttagacgcgatcgaagggtttggggctgggcctcaggaagcagcatcggaggtgcctcagccatggcatggatccctctcttcctcggcgtccttgcttactgcacaggatccgtggcctcctatgagctgactcagccacccctcagtgtccgtgtccccaggacagacggccaacatcacctgctctggagataaattggggcataaatatgtctgctggtatcaacagaaggcaggccagtcccctgtggttatcatctatcaagataacaagcggccctcagggatccctgagcgattctctggctccaactctgggaacacagccactctgaccatcagcgggacccaggctatggatgaggctgactattactgtcaggcgagggacagcagtactgcggtattcggcggagggaccaaggctgaccgttctaggtcagcccaaggctgccccctcggtcc

SEQ ID NO: 783822 - DNA, 512 bp, Homo sapiens
  misc_feature: HIJSMM301AO0U2.10.27.C05.1.454.light.4.raw
catagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttctaaggttttcggcggagggaccaggctgacccgtcctaagtcagcccgaaggctcggccccctcggt

SEQ ID NO: 783823 - DNA, 504 bp, Homo sapiens
  misc_feature: HIJSMM301B5DIV.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggtagggaccaggctgaccgtcctgagtcagcccaaggctgccccccg

SEQ ID NO: 783824 - DNA, 510 bp, Homo sapiens
  misc_feature: HIJSMM301D6WOF.5.68.G02.1.454.light.4.raw
  modified_base (219)..(219): a, c, t, g, unknown or other
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttanaagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaactaatttcattattcggcggagggaccaggctgaccgttcctgggtcagcccaaggcctgccccctcggtcactctcgttcccaccctcctccgtgt

SEQ ID NO: 783825 - DNA, 449 bp, Homo sapiens; identical to SEQ ID NO: 611478
  misc_feature: HIJSMM301BAWFO.18.9.A09.1.454.light.4.raw

SEQ ID NO: 783826 - DNA, 513 bp, Homo sapiens
  misc_feature: HIJSMM301AIAXE.47.83.H06.1.454.light.4.raw
agctcacgtacacgaccggtgctcgatttagatcacgtgcgtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagccagctcgccccctcggtcactctcgttccccg

SEQ ID NO: 783827 - DNA, 524 bp, Homo sapiens
  misc_feature: HIJSMM301E1IAU.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaaacaataattattatacttcgtggtacgttcggtccaaagggtaacccaagggttagggaatactacgtacgaacgtaaacctggttggccgttga

SEQ ID NO: 783828 - DNA, 499 bp, Homo sapiens
  misc_feature: HIJSMM301AHK59.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccgaagggaccaaggtggatatcagacgaactgtggtcgtcg

SEQ ID NO: 783829 - DNA, 504 bp, Homo sapiens
  misc_feature: HIJSMM301EAYD2.47.64.F09.1.454.light.4.raw
agctcacgtacacgaccggtgctcgattttagcgcgtatacaagggggaggaactgcgtcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccaggtccagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagccctgaagactttggactttattactgtcagcagcgtgagttctggcctccgctcactttcggcgggagggaccagggtggagatcaaacgaactgtggctggcaccgatctgtcttcattccc

SEQ ID NO: 783830 - DNA, 507 bp, Homo sapiens
  misc_feature: HIJSMM301CCUL1.3.79.H02.1.454.light.4.raw
  modified_base (457)..(457): a, c, t, g, unknown or other
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatcgtcggggctccaggctgaggacgaggctgcttatactgcagctcatatacaaggagcaccactctcgtggtatttggnggaggaccaagctgaccgtcctaggtcagcccaaggctcgccccctcggt

SEQ ID NO: 783831 - DNA, 503 bp, Homo sapiens
  misc_feature: HIJSMM301AXAJ8.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctctacgttcggcgggacggaccgagggtggagatacgaacgaacgtaactggtgctga

SEQ ID NO: 783832 - DNA, 516 bp, Homo sapiens
  misc_feature: HIJSMM301AZJ2T.10.39.D06.1.454.light.4.raw
catagtagtgcacgaccggtgctcgattttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgagggccggggatgaggccgactactactgccaggtgtgggatttcactactgatcatggtgggggtcgttcggcggagggaccaaggctgaccgtcctagtcacgaccaacggctcgcccccgtcgtcctaccg

SEQ ID NO: 783833 - DNA, 475 bp, Homo sapiens
  misc_feature: HIJSMM301ATVNY.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggactccctgagcgattctctggctccaactctagggaacacagccactctgaccatcagcgggacccaggctatggatgaggctgactattactgtcaggcgtgggacagcagcactccctatgtcttcgcactagggaccaaggtcaccgtcctaggtcacgacccg

SEQ ID NO: 783834 - DNA, 488 bp, Homo sapiens; identical to SEQ ID NO: 573804
  misc_feature: HIJSMM301A7AEF.46.35.D02.1.454.light.4.raw

SEQ ID NO: 783835 - DNA, 516 bp, Homo sapiens
  misc_feature: HIJSMM301AESMS.19.71.G05.1.454.light.4.raw
  modified_base (493)..(493): a, c, t, g, unknown or other
tactctcgtgcacgaccggtgctcgatttagtgtcgtcgcaagagagagggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattatacttcgtggtacgttcggtccgaacgggaaccaacggtaggtagtatacganaacgaactagtaggctacggcca

SEQ ID NO: 783836 - DNA, 487 bp, Homo sapiens
  misc_feature: HIJSMM301CXL3Y.9.50.E06.1.454.light.4.raw
  modified_base (200)..(200): a, c, t, g, unknown or other
tgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggcgacggaccgaagtggacatcaagcgaactgcggctgcgaccat

SEQ ID NO: 783837 - DNA, 494 bp, Homo sapiens
  misc_feature: HIJSMM301BB9WL.41.2.A02.1.454.light.4.raw
tctatactatcacgaccggtgctcgatttagactcatctacagggggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgttcaacagtctcatggtcctcccccttagtttcggcggagggaccaaggttgagatcaaacgactagtggctgcaccatctgttcttcattccc

SEQ ID NO: 783838 - DNA, 491 bp, Homo sapiens
  misc_feature: HIJSMM301AY0NS.53.10.A10.1.454.light.4.raw
  modified_base (475)..(475): a, c, t, g, unknown or other
  modified_base (487)..(487): a, c, t, g, unknown or other
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacagcggccctctggcatccctgggcgattctctggctccaactctgggaacacagccactctgaccatcagcgggacccagactaatggatgaggctgactattactgtcaggcatgggacagcgaaattggcggtggttcgggcgggggaccaaacgtgaccgtctaggtcagcccaaggcngcccctcggtcnctct

SEQ ID NO: 783839 - DNA, 496 bp, Homo sapiens
  misc_feature: HIJSMM301D55A7.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagccactctctatgtcttcggaactgggaccaaggtcacgtcctaggtcagcccaagg

SEQ ID NO: 783840 - DNA, 512 bp, Homo sapiens; identical to SEQ ID NO: 715611
  misc_feature: HIJSMM301AI2LA.40.81.H04.1.454.light.4.raw

SEQ ID NO: 783841 - DNA, 487 bp, Homo sapiens
  misc_feature: HIJSMM301AFZ2H.43.34.D01.1.454.light.4.raw
tgtgagtagtcacgaccggtgctcgatttagatcgtctgtgttgggtttgggggggggtcacaagaggcagcgctctcgggacgtctccaccatggcctgggctctgctgctcctcactctcctcgctcaggacacagggtcctgggccaagtctgccctgactcagcctgccctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggtaattgggacgacggtcaccgtcctaggtcag

SEQ ID NO: 783842 - DNA, 515 bp, Homo sapiens
  misc_feature: HIJSMM301EUFJN.22.36.D03.1.454.light.4.raw
acatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattagcgccactctcgtggttttcggcggaggcaccgaagtgaccgtcctcggtcagcccaaggctgccccctggtcactctcg

SEQ ID NO: 783843 - DNA, 491 bp, Homo sapiens
  misc_feature: HIJSMM301AVKUC.17.25.C03.1.454.light.4.raw
cgtagactagcacgaccggtgctcgatttagtagtgtagatttggggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctacaccatcaccactctgccaacctgaggattgtgcaatctactactgtcaacagagttacagttcccctcgctacttttggccgagggaccaaagttgagatcaaacgaactgtggctgcaccatctgtt

SEQ ID NO: 783844 - DNA, 500 bp, Homo sapiens
  misc_feature: HIJSMM301DUZPZ.18.37.D04.1.454.light.4.raw
  modified_base (498)..(498): a, c, t, g, unknown or other
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatggttggggtttattactgcatgcaaactacacacggccgctcactttcggcggaggaccaaggtggagatcaaacgactgtgctgcacanct

SEQ ID NO: 783845 - DNA, 511 bp, Homo sapiens
  misc_feature: HIJSMM301AQWY7.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgatcgattctctggctccaagtctggcacttcagccctccctggccatcagtgggctccagtctggggatgaggctgattattactgtgcaacatgggatgacagtctgaacgcaatggtgttcggcggagggaccaagggtcggccgtcctaggtcacgcccaaggcctcgccccctcggtcctac

SEQ ID NO: 783846 - DNA, 510 bp, Homo sapiens
  misc_feature: HIJSMM301CUP5J.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcaggtgggtctgggacagagttcactctcaccatcagcagcctgcagtctgaagtattttgtcggtttattactgtcagcagtataataactggtccctccacggtactacttttcggccgaggggaccaagctgggagactacaaacgaacgtgtggctgccaccatctgtt

SEQ ID NO: 783847 - DNA, 417 bp, Homo sapiens
  misc_feature: HIJSMM301EKXRB.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctcgtgggctccaggctgaggacgaggctgattattactgcagctcatatacaagcagcagcactcaagtcttacggaactgggaccaaggtcaccgtcctaggtcagcccaaggcccaacccatgtcactctgttcccaccctcctccatactcgta

SEQ ID NO: 783848 - DNA, 516 bp, Homo sapiens
  misc_feature: HIJSMM301BP7SS.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaaacaaacactcctggacccctgcccgattctcaggctccctccttgggggcaaagctgccctgacactgtctggtgtgcagcctgaggacgaggctgactattactgcctactctactttggtggtgctgtgctattcgggcggagggacccaaggctgaccgtcttaagtcagcccaaggctcgccccctcggtcactctgttcccta

SEQ ID NO: 783849 - DNA, 529 bp, Homo sapiens
  misc_feature: HIJSMM301BC240.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttactgtggggcgtggctatttgggtgttcgggcggtagggaccaaacgtcggaccgtccgtaggtcagcccaaggcctgccccctcggtcgacctcttcccg

SEQ ID NO: 783850 - DNA, 516 bp, Homo sapiens
  misc_feature: HIJSMM301CBRWD.11.57.F02.1.454.light.4.raw
  modified_base (470)..(470): a, c, t, g, unknown or other
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtggtctgggacagacttcattctcaccatccgcagcctagagcctgaagattttgctagtttattactgtcaacagcgtagcagcaggcctccggcgacgttcggccgaggacgaaggtggaagtcaagnaacgtgtgcgtgcaccatctgttcttctatccttcccgtccactcg

SEQ ID NO: 783851 - DNA, 456 bp, Homo sapiens
  misc_feature: HIJSMM301AMZ9C.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcgggcggagggaccaagctgaccgtcctaagtcagcgcaaggctgccccctcggtcactctcgttcccgccctcctccacgagagta

SEQ ID NO: 783852 - DNA, 502 bp, Homo sapiens
  misc_feature: HIJSMM301A91IS.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcaacaaagttggcctggcgcccaggctcctcatctatgatacattcaccagggccactggcatcccggacaggttcagaggcagtgggtatgggacagacttcactctcaccatcagcagacgtggagcctggagtattttgctagtttattactgtcagcagtatggttacttcacaaaccttcggccgaggggacacgactggagattaagcgaactgtggctgcaccatcttgtcttt

SEQ ID NO: 783853 - DNA, 501 bp, Homo sapiens
  misc_feature: HIJSMM301ANUFT.9.81.H04.1.454.light.4.raw
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtggaccacggtcaccgtcctaggtcagcccaaggcccaacccactgtcactt

SEQ ID NO: 783854 - DNA, 498 bp, Homo sapiens
  misc_feature: HIJSMM301AIJPN.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcacttctcaccatcagcagtctccaacctgaagattttgcaacttactactgtcaacagagtttcagtacgtccccggacgttcggcgacggaccgaacggtggacatcaaacgaacagtaggcgtgcaccactctgtcttt

SEQ ID NO: 783855 - DNA, 500 bp, Homo sapiens
  misc_feature: HIJSMM301AXIPN.3.31.C09.1.454.light.4.raw
  modified_base (441)..(441): a, c, t, g, unknown or other
  modified_base (485)..(485): a, c, t, g, unknown or other
agacgcactccacgaccggtgctcgatttagacgtctcatcaaggaaggaaggggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccaatcagagtgttagcaactacttagcctggtaccaacagaaacctggccaggctcccaggctcctcatctatgatgcatccaacagggccactggcatcccagccaggttcagtggcaggtgggtctgggacagacttcactctcaccatcagcagcctagagcctgaagattttgctagtttattactgtccagcagcgtagcaactggcctctcnctttcggcggagggaccaaggtggagatacaaacgaactgtggntgcaccatctgtctt

SEQ ID NO: 783856 - DNA, 506 bp, Homo sapiens
  misc_feature: HIJSMM301ATXKF.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcacacggcctccctgacatctctgggctccaggctgaggacgaggctgatttactactgctgctcatatgcaggtcgtatctcttatgtcttcggaactgggaccaaggtcaaccgtctaggtcagcccaaggcccaaccccactgtcta

SEQ ID NO: 783857 - DNA, 499 bp, Homo sapiens
  misc_feature: HIJSMM301C95KJ.16.78.H01.1.454.light.4.raw
  modified_base (62)..(62): a, c, t, g, unknown or other
tgtactactccacgaccggtgctcgatttagtgtgagtagtttgggtttgggggaggaactnctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtatttgtcggtttattactgtcagcagtataataactggcctccacggtactacttttggccgaggggaccaagctggagatacaacgaactgtggctgcacatctgtt

SEQ ID NO: 783858 - DNA, 437 bp, Homo sapiens
  misc_feature: HIJSMM301BH5NI.41.8.A08.1.454.light.4.raw
tctatactatcacgaccggtgctcgatttagcatactctacagggaaggatggagactgcgacatccagatgacccagtctccatcttccctgtctgcatctgtaggagacagagtcaccatcacttgtcgggcgagtcaggatattagcagctttttagcctggtatcagcagagaccagggaaagccccctaaactcctgatctatgctgcatccagtttgcaaagtggggtcccatcaaggttcagcggcagtggatctgggacagatttcactctcaccatcagcagcctgcagcctgacgattttgctaacttactattgtcaacaggctaacagtttcccgatgaccgtcggccaagggcacgactggacattaaacgaactgtggctgcaccatctgtcttcatccttcccgccatcgtgaatagtatga

SEQ ID NO: 783859 - DNA, 510 bp, Homo sapiens
  misc_feature: HIJSMM301ETD5W.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccgactcgtcactctgtcccta

SEQ ID NO: 783860 - DNA, 493 bp, Homo sapiens
  misc_feature: HIJSMM301BH6UV.5.6.A06.1.454.light.4.raw
atcagacacgcacgaccggtgctcgatttagatctactgacagggggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccaaggtaggaaagtacaaacgaactagtggcgtagcaccatctgtcttcta

SEQ ID NO: 783861 - DNA, 506 bp, Homo sapiens
  misc_feature: HIJSMM301AER54.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactccatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagccagtccccatgtgatcgttccgggcggggggaccgaagcctgaccgtccgtacggtcacgccc

SEQ ID NO: 783862 - DNA, 505 bp, Homo sapiens
  misc_feature: HIJSMM301B82FY.18.59.F04.1.454.light.4.raw
  modified_base (399)..(399): a, c, t, g, unknown or other
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgnggacgaggctgattattactgcagctcatatacaagcaccagcactctctatgtcttcggaactggggacctaagggtctaccgtcctagggtcaggccccaagga

SEQ ID NO: 783863 - DNA, 523 bp, Homo sapiens
  misc_feature: HIJSMM301ESOIM.51.53.E09.1.454.light.4.raw
cgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactcgaccgtcctacgtcacgcccaaggctgcccccgtcggtccactctgttcccccg

SEQ ID NO: 783864 - DNA, 444 bp, Homo sapiens
  misc_feature: HIJSMM301AFC1F.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggccctccagtctgcggatgaggctgtttatttctgttcagcacgggatgccagccggaatggcaattgggtattcggcggagggaccaagttgaccgtcctaagtcagcccaaggctgccccctcggtcactctgttcccgccctcctctgtcggcgt

SEQ ID NO: 783865 - DNA, 499 bp, Homo sapiens
  misc_feature: HIJSMM301BC2OF.15.49.E05.1.454.light.4.raw
tctacgtagccacgaccggtgctcgatttagagcgactagcaacacacaaaggggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgcccagggccactggcatcccagccacgttcagtggcaggtgggtctgggacaggagttcattctcaccatcagcagcctgcagtctgaagtattttgctagtttattactgtcagcagtataatgactggcctccgacgttccggccgaacgggaccgaaggtaggaaatacaaacgaactagtggctgcacc

SEQ ID NO: 783866 - DNA, 496 bp, Homo sapiens
  misc_feature: HIJSMM301CIIT4.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcaggcgggtctgggacagatttcactctcaccatcagcagcctgcaggctgaagatgtggctagtttattattgtcaacaatattattatacttgtggacgttcggccaagggaccaaggtggatatcagacgaactgtggctg

SEQ ID NO: 783867 - DNA, 497 bp, Homo sapiens
  misc_feature: HIJSMM301C9HIU.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggttcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggttttattactgtcagcagtataataactgcctcacgtacacttttggcaggggaccaagctggagatacaaacgaactgtgctgcaccatctgtctta

SEQ ID NO: 783868 - DNA, 490 bp, Homo sapiens
  misc_feature: HIJSMM301CHY65.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtataggtcacgtccccaagaacttttggcctaggggaccaagctggagatcaaacgaactagtggctgcaccat

SEQ ID NO: 783869 - DNA, 494 bp, Homo sapiens
  misc_feature: HIJSMM301A7D4E.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacaggacttcactctcaccatcagcagcctagagcctgaagattttgcactttattactgtcagcagcgtagcaatcggcctctcacgtttcggcggagggaccaggggtggagatcagacgaactgtggctggcacatctgtt

SEQ ID NO: 783870 - DNA, 512 bp, Homo sapiens
  misc_feature: HIJSMM301EF4FB.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaacgtctgggtgttcggcggaggaccaagctgaccgtcctacggtcagcccaaggcctgcccccttcggtccaccttcttccg

SEQ ID NO: 783871 - DNA, 512 bp, Homo sapiens; identical to SEQ ID NO: 556539
  misc_feature: HIJSMM301AT90E.5.58.F03.1.454.light.4.raw

SEQ ID NO: 783872 - DNA, 481 bp, Homo sapiens
  misc_feature: HIJSMM301AKYUY.41.23.C01.1.454.light.4.raw
tctatactatcacgaccggtgctcgatttagtacacgtgattagggattgggggctgtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttagttgggtgttcgggcggacgggaccaagctgaccgtccgttcggtc

SEQ ID NO: 783873 - DNA, 503 bp, Homo sapiens; identical to SEQ ID NO: 552088
  misc_feature: HIJSMM301CSLAN.2.35.D02.1.454.light.4.raw

SEQ ID NO: 783874 - DNA, 498 bp, Homo sapiens
  misc_feature: HIJSMM301EV7AC.18.59.F04.1.454.light.4.raw
tacgagtatgcacgaccggtgctcgatttagtacacacacttagggattggggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccagga

SEQ ID NO: 783875 - DNA, 509 bp, Homo sapiens
  misc_feature: HIJSMM301ECR4K.8.28.C06.1.454.light.4.raw
  modified_base (498)..(498): a, c, t, g, unknown or other
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggaagggaccaagggtcggacctcaaacgaactggtggctgcaccatctgtcttnactcttcccgc

SEQ ID NO: 783876 - DNA, 489 bp, Homo sapiens
  misc_feature: HIJSMM301EYT3T.46.26.C04.1.454.light.4.raw
  modified_base (426)..(426): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcagcacagattttacactagaaaatcagcagagtggaggctgaggatggttggctctattattgcatnacagctctacaacgtcccgctcactttcggcggagggaccgaaggtaggagatacaaacgact

SEQ ID NO: 783877 - DNA, 507 bp, Homo sapiens
  misc_feature: HIJSMM301A8N47.40.59.F04.1.454.light.4.raw
tctagcgactcacgaccggtgctcgatttagtacacacacttagggattggggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtggaggttgggttttcgggcgggtaggggaccgaaggctcgtacccgtaccgtaacgtccgacggcccgaaacggtcccg

SEQ ID NO: 783878 - DNA, 508 bp, Homo sapiens
  misc_feature: HIJSMM301CAUZ9.8.28.C06.1.454.light.4.raw
ctcgcgtgtccacgaccggtgctcgatttagagctcacgtattgggtttggggggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagttttatttctgtcagcagtctgaagactggccgttcactttcggcggagggaccaagggtggacctcaaacgaactgtaggctgcaccatctgtcttcatcttcccgccat

SEQ ID NO: 783879 - DNA, 499 bp, Homo sapiens
  misc_feature: HIJSMM301D0R2Y.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgctaccttttattactgtcagcagcgtagcaactggcctctctactttcggcgggagggaccgagggtggagatcacgacgaactgtggctgcaccatctgtt

SEQ ID NO: 783880 - DNA, 502 bp, Homo sapiens
  misc_feature: HIJSMM301CSQKS.9.19.B08.1.454.light.4.raw
tgatacgtctcacgaccggtgctcgatttagtgagtcagtaagggggcttcgagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcactctttggttacagtaatcggccctcaggggtccctgaccgattctctggctccaagtctgacacctcagcctccctggccatcactcgggctccagactgaggatgaggctcattattactgccagtcttatgacaaacgtcagaactagtttgggtgttcggcggagggaccaagctcgaccgtcctcgagtccagaccccg

SEQ ID NO: 783881 - DNA, 528 bp, Homo sapiens
  misc_feature: HIJSMM301E19WD.7.86.H09.1.454.light.4.raw
cgtgtctctacacgaccggtgctcgatttagtgctatagacttggggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagagtagttatttagcctggtatcggcaaaaacctggccaggctcccgactcctcttctttggtggagcctacagggccactggcaccccagacaggatcagtggcagcgggtctgggacagacttcattctcaccatcaacagactgcagcctgaagatatttgcagtttactactgtcagcagtattgttacgtccccgtggaccgttcggccaagggaccgaacggtggacaactcaaccgaactagtggctgcaccatctcgtcttcattccttccccg

SEQ ID NO: 783882 - DNA, 497 bp, Homo sapiens
  misc_feature: HIJSMM301ASGDU.10.79.H02.1.454.light.4.raw
  modified_base (489)..(489): a, c, t, g, unknown or other
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccgagggaccgaagctggagatcaaacgaactgtggctgcaccatctntcttctac

SEQ ID NO: 783883 - DNA, 525 bp, Homo sapiens
  misc_feature: HIJSMM301EJ2PD.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacctgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggttgttcgggcggagggaccaggctcgaccgtcctaggtcacgcccaaggctcgccccctcggtctactctcgttcccg

SEQ ID NO: 783884 - DNA, 510 bp, Homo sapiens
  misc_feature: HIJSMM301A4Q0U.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgtattactactgctgctcatatgcaggtcgtatctcttatgtcttcggaactgggaccaaggtcaccgtcctaggtcagcccaacggcccaaccccactgtact

SEQ ID NO: 783885 - DNA, 511 bp, Homo sapiens
  misc_feature: HIJSMM301CZRUI.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcgggcggagggaccaagttgaccgtcctaggtcagccaaggctcgccccctcggtcactccg

SEQ ID NO: 783886 - DNA, 499 bp, Homo sapiens
  misc_feature: HIJSMM301AK4KB.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacgtcctaggtcagccaggccaccca

SEQ ID NO: 783887 - DNA, 498 bp, Homo sapiens
  misc_feature: HIJSMM301BLUQF.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcaggtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttcatcttccccg

SEQ ID NO: 783888 - DNA, 501 bp, Homo sapiens
  misc_feature: HIJSMM301ELF0Q.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttatagctccaccaataagagctacttagcttggttccagcagaaaccaggacatcctcctctactgctcatttactgggcgtctacccgggaatccggggtccctgaccgattcagtggcagcgggtctgggacagattcactctcaccatcagcagcctgcaggctgaagatgtggctagtttattactgtcagcaatattatattcctcctcagacgttcggccaagggaccaaggtgaaatcaaacgaactgtcggactgcaccta

SEQ ID NO: 783889 - DNA, 482 bp, Homo sapiens
  misc_feature: HIJSMM301ARMTG.10.74.G08.1.454.light.4.raw
catagtagtgcacgaccggtgctcgatttagtagctctatcaggggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttatactgtcagcagtatactaactggcctctgacgttcggccaagggaccagggtggaaatacaaacgaactggtaggctgcaccat

SEQ ID NO: 783890 - DNA, 506 bp, Homo sapiens
  misc_feature: HIJSMM301DK5GY.2.35.D02.1.454.light.4.raw
  modified_base (405)..(405): a, c, t, g, unknown or other
  modified_base (465)..(465): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgnttattactgcagctcatatgcaggcagcagcaatgtacttttcggcggagggaccaagcngaccgtcctgggtcagccaaggctgccccctcggtctaccg

SEQ ID NO: 783891 - DNA, 495 bp, Homo sapiens
  misc_feature: HIJSMM301DK7VO.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcaactttcggcggtagggaccaagggtggagattcaaacgaa

SEQ ID NO: 783892 - DNA, 501 bp, Homo sapiens
  misc_feature: HIJSMM301ESV1H.18.78.H01.1.454.light.4.raw
tacgagtatgcacgaccggtgctcgatttagtgtgagtagtttgggtttggggggggtctcaaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtcctaggtcagcccaaggccaacccatg

SEQ ID NO: 783893 - DNA, 514 bp, Homo sapiens
  misc_feature: HIJSMM301A6NUF.16.1.A01.1.454.light.4.raw
tgtactactccacgaccggtgctcgatttagacgtctcatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgttggttttcggcggagggaccaagctgccgtcctaggtcagccaaggctgccccctcggtcactctgttccccg

SEQ ID NO: 783894 - DNA, 506 bp, Homo sapiens
  misc_feature: HIJSMM301AODLS.40.45.E01.1.454.light.4.raw
tctagcgactcacgaccggtgctcgatttagtgagtcagtaagggaaagggggaggaactgctcagttaggacccagagggaaccatggaagccccagctcagcttctcttcctcctgctactctggctcccagtaatcaccggagaaattgtgttgacacagtctccagccaccctgtccttctctccaggggaaagagcctccctctcctgcagggccagtcagagtattaataccttcttggcctggtaccagcaaaagcctggccaggctcccagactcctcatctatgatgcatccaacagggccactggcgtcccggccaggttcagtggcagtgggtctgggacagacttcactctcaccatcagcagcctagagcctgaagattttgctagtttattactgtcagcagcgtgccaactggcctctctactttcggcggagggaccgaaggtaggagatacaaacgaactgtggctgcacatctgtcttcatcttcccg

SEQ ID NO: 783895 - DNA, 495 bp, Homo sapiens
  misc_feature: HIJSMM301BSA66.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttttactgtcagcagtatagtaactggcctccgtactacttttggccgaggggaccaagctagaaatcaaacgaactgtggctgcaccatctgtcttct

SEQ ID NO: 783896 - DNA, 498 bp, Homo sapiens
  misc_feature: HIJSMM301DZAZF.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccataagctgcagatgattggtccgtccagtttccaagatggggccccatcgagattccgcgtcagtggatctgggacagatttcactctcaccatcagcagcctgcagcctgaagattttgcaactttactattgtcagcaggcgcacaatttcccgctcactttcggcggacgggtaccaaggtggagatacaaacgaactgtacggctgcaccatctgtcttc

SEQ ID NO: 783897 - DNA, 462 bp, Homo sapiens
  misc_feature: HIJSMM301DGJIF.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtcggtgttcggcggagggaccaggctgaccgtcctaagtcagcccaaggctcgccccctcggtcactctgttcccaccctcctcctgctacg

SEQ ID NO: 783898 - DNA, 495 bp, Homo sapiens
  misc_feature: HIJSMM301B7R31.11.28.C06.1.454.light.4.raw
cgagagataccacgaccggtgctcgatttagagctcacgtattggggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcggctcgcagttccggcggacgggaccgaaggtggagatacaaacgaa

SEQ ID NO: 783899 - DNA, 528 bp, Homo sapiens
  misc_feature: HIJSMM301C9B1X.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacgttgggtgttcggcggagggaccgaggctgaccgtcctaggtcagcccaaggctcgccccctcggtcactctcgttcccgccctccc

SEQ ID NO: 783900 - DNA, 535 bp, Homo sapiens
  misc_feature: HIJSMM301AI6HW.52.33.C11.1.454.light.4.raw
cgcagtacgacacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgccacctcatatgcgaggcgaacaactaagttttggggggttttccggacgggagggaccaagggtcgaccgtcctaccgtcacgcccgaaggcctcgccccctcggtccactctcgtt

SEQ ID NO: 783901 - DNA, 489 bp, Homo sapiens
  misc_feature: HIJSMM301B2KRI.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtaggatatcagacgaa

SEQ ID NO: 783902 - DNA, 384 bp, Homo sapiens
  misc_feature: HIJSMM301DJKRV.48.87.H10.1.454.light.4.raw
agtatacatacacgaccggtgctcgatttagcagtactgcgttgggtttgggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtcccggggtccctgaccgattcagtgccagcgggtctgggacagacttcactctcacca

SEQ ID NO: 783903 - DNA, 512 bp, Homo sapiens
  misc_feature: HIJSMM301B6NZY.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctggaggacgaggctgatttattattgctgctcatatgcaggtagttacactttatgtcttcggaattggggacgacggtcaccgtcctaggtcacgacccaaggcccaaacccctacg

SEQ ID NO: 783904 - DNA, 512 bp, Homo sapiens
  misc_feature: HIJSMM301BMBMP.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgttgggtgttcggcggagggaccaagttgaccgtccgtaggtcagcccaaggcctcgccccctcggtccactctgtt

SEQ ID NO: 783905 - DNA, 503 bp, Homo sapiens
  misc_feature: HIJSMM301D7A7U.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggccgtccggggtccctgacaggttcagtggcagtggatcaggcacagtattttacactagaaaatcagcagagtggaggctgaggagttggtttggggtttattactgtcatgcaagctactacaaactccttactactttggccgaggggaccaaggctggagatacaaacgaactgt

SEQ ID NO: 783906 - DNA, 419 bp, Homo sapiens
  misc_feature: HIJSMM301C3KKX.9.34.D01.1.454.light.4.raw
tgatacgtctcacgaccggtgctcgatttagatcgtctgtgttgggtttgggggctgttcctggaagttgttggtaccagtgtcaccatctcgtgcactggaagtagctccaacatcggggcacgttatgatgtacactggtaccaacaacttccaggaacagccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccaccctcctcagacgtatca

SEQ ID NO: 783907 - DNA, 504 bp, Homo sapiens
  misc_feature: HIJSMM301BSZOK.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctagtcagcccaaggcccaacccta

SEQ ID NO: 783908 - DNA, 494 bp, Homo sapiens
  misc_feature: HIJSMM301EEMIN.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttatactgtcagcaatattatattcctcctcagacgtcgccaaggaccaaggtgaaatcaaacgactgtggctgcactac

SEQ ID NO: 783909 - DNA, 536 bp, Homo sapiens
  misc_feature: HIJSMM301BE7Y5.13.81.H04.1.454.light.4.raw
tcacgtactacacgaccggtgctcgatttagtagtgtagattcgcgggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcatcgtctcctgcactggaaccagcactgatgttggtggttataactatgtctcctggtatcaacaacacccaggcaaagcccccaaaactcatcatttatgaagtcatttatcggccctcagggatttctaatcgcttctctggctccaagtctggcaacacggcctccctgaccatctctgggctccaggctgaagacgaggctgattattactgcagctcatatacaaccatacaacaccaactaggttccttacggaaggtacgggaaccaaaaggtctacccgtcctaaggtcaacgaccccaaggacccaaccccctaactgtacacttccg

SEQ ID NO: 783910 - DNA, 505 bp, Homo sapiens; identical to SEQ ID NO: 554737
  misc_feature: HIJSMM301AQ14D.40.67.G01.1.454.light.4.raw

SEQ ID NO: 783911 - DNA, 504 bp, Homo sapiens
  misc_feature: HIJSMM301AQ592.49.6.A06.1.454.light.4.raw
agtcgagagacacgaccggtgctcgatttagatctactgacagggggctggggtctcaggaggcagcgctctcaggacgtcaccaccatggcctgggctctgctcctcctcaccctcctcactcagggcacagggtcctgggcccagtctgccctgactcagccgccctccgcgtccgggtctcctggacagtctgtcaccatctcctgcactggaaccagcagtgacgttggtgattataactatgtctcctggtaccaacagtacccaggcaaagcccccagactcatgatttatgcggtcagtaagcggccctcaggggtccctgatcgcttctctggctcaagtctggcaacacggcctccctgaccgtctctgggctccgggctgaagatgaggctgatttatttctgcagctcatatgcaggcagcaactaattttgtgtatattcgggcggagggaccaagctcgacccgtcgtacggtcgacgcccaaggcctccc

SEQ ID NO: 783912 - DNA, 448 bp, Homo sapiens
  misc_feature: HIJSMM301D937K.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctcgaccgtcctaagtcagcccaaggctcgccccctcggtcactctcgttcccgccctcctccgtgtctgat

SEQ ID NO: 783913 - DNA, 528 bp, Homo sapiens
  misc_feature: HIJSMM301AZAAL.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcgggcgggagggaccgaggctgaccgtcctaggtcagcccaaggctcgccccctcggtcactctcgttcccaccct

SEQ ID NO: 783914 - DNA, 512 bp, Homo sapiens
  misc_feature: HIJSMM301A3XUE.40.34.D01.1.454.light.4.raw
tctagcgactcacgaccggtgctcgatttagatcgtctgtgttgggtttgggggtggtagctcaggaagcagagcctggagcatctccactatggcctgggctccactacttctcaccctcctcgctcactgcacaggttcttgggccaattttatgctgactcagccccactctgtgtcggggtctccggggaagacggtaaccatctcctgccaccccgcagtagtggcagcattgccagcaactatgtgcagtggtaccagcagcgcccgggcagttcccccaccactttaatctatgaggataacaaaagactctctggggtccctgatcggttctctggctccatcgacagctcctccaattctgcctccctcaccatctctggactgaagactgaggacgaggctgattattactgtcagagttatgatgacaccaattactggggttgttcgggcggagggaccagcctgaccgtccgtaggtccagcccaaggctcgccccctc

SEQ ID NO: 783915 - DNA, 507 bp, Homo sapiens
  misc_feature: HIJSMM301EPOMT.8.42.D09.1.454.light.4.raw
ctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttcgaccggtcctaggtcagcccaaggctcgccccctcggtcacctctgtt

SEQ ID NO: 783916 - DNA, 507 bp, Homo sapiens
  misc_feature: HIJSMM301BBSGM.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccaccccggcagagcccccaaactcatgatttatgaggccactaagcgaccctcagggtctttctaatcgcttctctggctccaagtctggcaacacggccctccctgacaatctctgggctccaggctgacgacgaggctaattattactgctgctcatatgaaggttataacactatacttattcggcggagggaccaagctgaccgtcctgcgtcagcccaaggcctgccccctcggtcactt

SEQ ID NO: 783917 - DNA, 505 bp, Homo sapiens
  misc_feature: HIJSMM301A76Q8.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgtcggtccaggaccaacggtggaaggtacaaacgaaccgtaggtcgtcgtcgccacgactcgtcgttcctt

SEQ ID NO: 783918 - DNA, 494 bp, Homo sapiens
  misc_feature: HIJSMM301CQBUX.5.35.D02.1.454.light.4.raw
  modified_base (460)..(460): a, c, t, g, unknown or other
atcagacacgcacgaccggtgctcgatttagcacacgatagttgggtttgggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccacgggaccacagtggatntcaggcgaactgtggctgcaccatctgtcttcta

SEQ ID NO: 783919 - DNA, 531 bp, Homo sapiens
  misc_feature: HIJSMM301AGX92.10.26.C04.1.454.light.4.raw
  modified_base (207)..(207): a, c, t, g, unknown or other
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggganagccaccctctcctgcagggccagtgaacctttttagtagtagttatttagcctggtatcggcaaaaacctggccaggctccccgactcctcttctttggtggagcctacagggccactggcaccccagacaggatcagtggcagcgggtctgggacagacttcattctcaccatcaaacagactgcagcctgaagatattgcagtttactactgtcagcagtatgttacgtccccggtggacgttcggtccaagggaccaaggtggacgaatacaaccgaacctaggtggctgcacaactctgtcttctatccttcccgccta

SEQ ID NO: 783920 - DNA, 513 bp, Homo sapiens
  misc_feature: HIJSMM301CL1CZ.15.86.H09.1.454.light.4.raw
tctacgtagccacgaccggtgctcgatttagtgctatagacttgggtttgggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacgggatccccgatcgcttcatgggctccagttctggggctgaccgctacctcaccatctccaaccgtccagtctgacgatgaggctgagtatcactgtggagagagccacacaattgatggccaagacggttgggtgttcggcgggagggaccaaggctgaccgtcctaggtcacgg

SEQ ID NO: 783921 - DNA, 491 bp, Homo sapiens
  misc_feature: HIJSMM301CM6LS.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgttctcggaactgggaccaggtcaccgtcctagtcagccc

SEQ ID NO: 783922 - DNA, 510 bp, Homo sapiens
  misc_feature: HIJSMM301AK46X.9.12.B01.1.454.light.4.raw
  modified_base (388)..(388): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccgggtccctgaccgattcagtggcagcgggtctgggacagatttcactctcaccatcagcagcctgcnggctgaagatgtggcagtttattactgtcaactagttttctcgggcgttcgtcgaagggaccgaaggtaggaaatacaaacgaactagtaggctgcaccactctgtcttctactcttccccg

SEQ ID NO: 783923 - DNA, 488 bp, Homo sapiens
  misc_feature: HIJSMM301EP55W.13.5.A05.1.454.light.4.raw
tcacgtactacacgaccggtgctcgatttagatagatagacagggggtgggtccaggaggcagaactctgggtgtctcaccatggcctggatccctctacttctccccctcctcactctctgcacagctctgaggcctcgtatgagctgacacagccactctcggtgtcagtgtccccaggacagacggccaggatcacctgctctgcagatgcattgccataacattttgcttattgctgtcagcagaaaccaggccaggccaggcccaggcccctatattcctgatataaaaagacattgaggggccctcagtgatccctgagcgattctctggctccatctcagggacaacagtcacgttgaccatcagtggagtccaggcagaggacgaggctgactgttagtgactttcagcagacaacagtggacttcgtgatttcgacggtacggaccaactcgaccgtcctcgcgtcagcccaaggtccg

SEQ ID NO: 783924 - DNA, 487 bp, Homo sapiens
  misc_feature: HIJSMM301D8NVO.26.60.F05.1.454.light.4.raw
  modified_base (314)..(314): a, c, t, g, unknown or other
agactatactcacgaccggtgctcgatttagtacgtcatcagggaaaggggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaaacttagcctggcaccagcagaaacctgggcaggctcccaggctcctcatctttgatgcgtccaccagggccacnggtttcccagccaggttcagtggcagtgcgtctgcgacagagttcactctcaccatcaacagcctgcagtctgaagattttgctagtttattactatcagcagtatcatgactcggccgctcaccttcggccaagggacacgactggagattaaacgaactgtggctgcacat

SEQ ID NO: 783925 - DNA, 423 bp, Homo sapiens
  misc_feature: HIJSMM301DS79C.41.53.E09.1.454.light.4.raw
tctatactatcacgaccggtgctcgatttagagagagtgtgttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcgggcggagggaccaagctgaccgtcctaggtcagcccaaggctgccccctggtccactctcgttccccacccttcctcatagtataga

SEQ ID NO: 783926 - DNA, 510 bp, Homo sapiens
  misc_feature: HIJSMM301EL0MZ.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagccaaggctgccccctcggtcactctgttccccg

SEQ ID NO: 783927 - DNA, 509 bp, Homo sapiens; identical to SEQ ID NO: 540045
  misc_feature: HIJSMM301BGUSE.11.57.F02.1.454.light.4.raw

SEQ ID NO: 783928 - DNA, 503 bp, Homo sapiens
  misc_feature: HIJSMM301CUPLR.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcatagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatgaggccgactactactgccaggtgtgggatttcactactgatcatgtggggtcttcgggcggagggaccaagctgaccgtcctaagtcagccaaggctgccccctcggtcta

SEQ ID NO: 783929 - DNA, 484 bp, Homo sapiens
  misc_feature: HIJSMM301AGL8I.5.41.D08.1.454.light.4.raw
atcagacacgcacgaccggtgctcgatttagtcacgcgagaaagggaaaggggctgatcaggactcctcagttcaccttctcacaatgaggctccctgctcagctcctggggctgctaatgctctgggtctctggatccagtggggagattgtgctgactcagtctccactctccctgtccgtcacccctggagagccggcctccatctcctgcaggtctagtcagagcctcctgcatagtaatggattcaactatttggattggtacctgcagaggccagggcagtctccacagctcctggtctatttgggctcttatcgggcctccggggtccctgagaggttcagtggcagtggatcaggcacagactttacactgcgaatcagcagagtggaggctgaggatgttggggtttattactgcatgcaagctctacaaaccctattcactttcggccctgggaccagagtggatatcaaacga

SEQ ID NO: 783930 - DNA, 512 bp, Homo sapiens
  misc_feature: HIJSMM301DIQ0M.43.62.F07.1.454.light.4.raw
tgtgagtagtcacgaccggtgctcgatttagtagtcgcataaagggaaagggggcaggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaatttggtatcaggagaacccagggaaagcccctaagctcctgatctatgctacttccactttgcaaagtgggtcccatctaggttcagtggcagtggatcggggacacatttcactctcaccatcagtagtctgcaacctgaagattatgcaacttaacttctgtcaacagagtagacacgaaacccgtggaacgttccgggtaccaacgggaccgaaggtggaaagacaaacgaactagtggctggcaccatctgtcttctac

SEQ ID NO: 783931 - DNA, 499 bp, Homo sapiens
  misc_feature: HIJSMM301EOZPG.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatccgggcctccggggtccctgacaggttcagtggcagtggatcaggcacagtattttacactagaaaatcagcagagtggaggctgaggatgttgggctctattattgcatgacaagctctacaacgtcccgctccacgtttcggcgggacgggaccgaagggtggagatacgaaacgaact

SEQ ID NO: 783932 - DNA, 515 bp, Homo sapiens
  misc_feature: HIJSMM301BWDHB.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggagtcctccccagtttctcctgaggttcaggtcaaactcagataaacgacagggctctggagtccccagccgcttctctggatccaaggatgattccgccaacgcagggatattactcatctcttggctccagtctgacgatgaggctgactattactgtttgacttggcacaacaacgcctggatcttcggacctgggaccacggtcaccgtcctaggtcacgacccaacggcccaacccccactcgtcactctcgttcccccg

SEQ ID NO: 783933 - DNA, 513 bp, Homo sapiens
  misc_feature: HIJSMM301CDNTN.10.29.C07.1.454.light.4.raw
catagtagtgcacgaccggtgctcgatttagagtgctacgaaggggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacacccaggcaaagccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaacccagacagcacttctgttattcggcggagggacccaagctgaccgtcctaggtcagcccaaggctcgccccctcggtctacc

SEQ ID NO: 783934 - DNA, 523 bp, Homo sapiens
  misc_feature: HIJSMM301EDMBE.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcggagggaccaggctgaccgtcctaggtcagcccaaggctcgccccctcggtcactctgttcccaccct

SEQ ID NO: 783935 - DNA, 502 bp, Homo sapiens
  misc_feature: HIJSMM301DQP1K.7.1.A01.1.454.light.4.raw
cgtgtctctacacgaccggtgctcgatttagacgtctcatcaaggaagggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggaggaccaagctgaccgtctaggtcagcccaaggctgccccctc

SEQ ID NO: 783936 - DNA, 492 bp, Homo sapiens
  misc_feature: HIJSMM301APCSQ.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggcccaccggtatcccagccaggttcagtggcaggtgggtctgggacagagttcactctcaccatcagcagcctgcagtctgaggattttgctagtttattactgtcagcattacaataactggcctcggctccactttcggcggagggaccgaaggtggagatacaaacgaactgtggctgccacat

SEQ ID NO: 783937 - DNA, 506 bp, Homo sapiens
  misc_feature: HIJSMM301A1E5P.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttggtgttcggcggaggacaagctgaccgtcctaggtcacgcccaaggctcgccccctcggtcactcttccg

SEQ ID NO: 783938 - DNA, 335 bp, Homo sapiens
  misc_feature: HIJSMM301AQ3P1.4.39.D06.1.454.light.4.raw
agcactgtagcacgaccggtgctcgatttagtgacatctcgcagttctttgggggctaaaaggaaggtccccaagaccctgtggcctggagtgggttgatatggaacagtgggcggactagtggggggcagggcagccttggagttacaagtgaatcccaaggccttggaacaggcagcaacctatggggtatgtgaagcccagaggggtatgtttgggagggagatcgtgagtgtgtgtgaaaaggggtgctgtctctaaggattggagcatgggagtgcgagacccaagttaagagtcccgagatcgcagagttaagagacctgagaactggt

SEQ ID NO: 783939 - DNA, 546 bp, Homo sapiens
  misc_feature: HIJSMM301AM4LJ.7.34.D01.1.454.light.4.raw
cgtgtctctacacgaccggtgctcgatttagatcgtctgtgttggggtttgggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacgaggggacagactattagtttgggttggttcgggcgggagggaaccgaaaggctcggtacccggtccttcggccgtcaggcccgaacggcctcgccccccgtcggtccacttccg

SEQ ID NO: 783940 - DNA, 518 bp, Homo sapiens
  misc_feature: HIJSMM301DBCUP.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggtagggaccaagctgaccgtcctaggtcagccaaggctcgccccctcggtcctactctgttcccccg

SEQ ID NO: 783941 - DNA, 473 bp, Homo sapiens
  misc_feature: HIJSMM301EHNA5.4.76.G10.1.454.light.4.raw
agcactgtagcacgaccggtgctcgatttagtcactcatacaggggggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgtgcaacttattactgtcaacaatataacaattattggacgttcggacctaagggaccaagggtgaaatcaaacgaactgtgctgcacc

SEQ ID NO: 783942 - DNA, 354 bp, Homo sapiens; identical to SEQ ID NO: 540485
  misc_feature: HIJSMM301DEUF2.40.9.A09.1.454.light.4.raw

SEQ ID NO: 783943 - DNA, 521 bp, Homo sapiens
  misc_feature: HIJSMM301DSU6O.8.87.H10.1.454.light.4.raw
ctcgcgtgtccacgaccggtgctcgatttagcagtactgcgttgggtttgggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggactgagggtgactattctgtcaagtgtgggacaccaacacttgtgtcttcgggactgggccgaggtcaccgtcctaagtcagcccagggccaaccccgactgtcactctgttcccaccctcctcgacaccgg

SEQ ID NO: 783944 - DNA, 491 bp, Homo sapiens
  misc_feature: HIJSMM301DNX75.5.73.G07.1.454.light.4.raw
  modified_base (192)..(192): a, c, t, g, unknown or other
atcagacacgcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccacactctcctgcagggccagtcagagtgttagtggccgcttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagtattttgctagtttattactgtcagcagtataacgactggtggacgttcggcctaagggaccaaggtaggaaaccaaacgaactgtggctgcaccatctgtcttctac

SEQ ID NO: 783945 - DNA, 511 bp, Homo sapiens
  misc_feature: HIJSMM301EQNL0.22.38.D05.1.454.light.4.raw
acatacgcgtcacgaccggtgctcgatttagtatctgatagttggggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgctagtttattactgtcagcagcgtagcatctggcctccgtaccacctttcggccaggggaccaaggctggagatacaaacgaactggtggctgcaccatctgtcttctattccc

SEQ ID NO: 783946 - DNA, 504 bp, Homo sapiens
  misc_feature: HIJSMM301E4G0T.16.68.G02.1.454.light.4.raw
  modified_base (492)..(492): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactcctcactatcaccagcctgcaacctgatgattttgcaacttattactgccaacagtatcatcatcattgtaatttcggtggacggggaccaaggtggaggttacaaaccgaactaggtggctgcacctatctntctttcattccc

SEQ ID NO: 783947 - DNA, 527 bp, Homo sapiens
  misc_feature: HIJSMM301DR3F5.4.39.D06.1.454.light.4.raw
agcactgtagcacgaccggtgctcgatttagtgacatctcgcagttcgtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcattaatttatgaggtcactaagcggccctcaggggtccctgatcgcttctctgcctccaaggctggacaacaccggcctccctgaccgtctctgggctccaggctgaggatgaggctgattattattgcagctcatatgcaggcagttacaattgtagattattcgggcgggtacgggaccgaaaactcgacccgtcctaaggtcacggccccaaggcctcgccccccttcc

SEQ ID NO: 783948 - DNA, 491 bp, Homo sapiens
  misc_feature: HIJSMM301CDVZO.49.55.E11.1.454.light.4.raw
agtcgagagacacgaccggtgctcgatttagcactcgcacgttgggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtccgtattcgggcggacggggaccaaggctgaccgtcctaggtcacggcccaac

SEQ ID NO: 783949 - DNA, 503 bp, Homo sapiens
  misc_feature: HIJSMM301CJ4GR.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgatttattattgctgctcatatgcaggtagttacacttatgtcttcggaattgggacgacggtcaccgtcctaggtcacgcccaaggccaaccccta

SEQ ID NO: 783950 - DNA, 479 bp, Homo sapiens
  misc_feature: HIJSMM301C5L5E.46.26.C04.1.454.light.4.raw
actagcagtacacgaccggtgctcgatttagtctagcgactttggggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggtctaatcggcctccgggtccctgacaggttcagtggcagtggatcaggcacagattttaacactgaaaatcagcagagtggaggctgaggatgttgggctctattattgcatgcaagctactacaagtcccgctcacgtttcggcggagggaccgaggtcggagatc

SEQ ID NO: 783951 - DNA, 537 bp, Homo sapiens
  misc_feature: HIJSMM301DMPBO.27.23.C01.1.454.light.4.raw
  modified_base (518)..(518): a, c, t, g, unknown or other
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatcttccgggctccagccgtgaggacgaggctgattattattcgtagttcattaatacaaccaagtgacacttgggttgttcgggcggagggacccagggcttgaccgtcctagggtcaggcccaaggctgccccctggcnctctcgttcccaccctccc

SEQ ID NO: 783952 - DNA, 501 bp, Homo sapiens
  misc_feature: HIJSMM301C015I.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggatttggtacctgcagaagccagggcagtctccacagctcctgatctatttgggttctaatcgggcctccggggtccctgacaggttcagtggcagtggatcaggcacagattttacactgaaaatcaagcagagtggaggctgaggatgttggggtttattacttgcatgcaagctctacaaacctaccttacaactttttggccagggggacccaagactggagatcaaacgaactgt

SEQ ID NO: 783953 - DNA, 507 bp, Homo sapiens
  misc_feature: HIJSMM301BN2VW.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcggatctgggacagacttcactctcaccatcagcagcctagagtctgaagattttgctagtttattactgtcagcagcggggcaattggccgctcacgtttcggcgggggaccgaaggtggagttcaaacgaactgtggctgcaccatctgtcttcatccttccccg

SEQ ID NO: 783954 - DNA, 505 bp, Homo sapiens
  misc_feature: HIJSMM301A1AAJ.18.59.F04.1.454.light.4.raw
tacgagtatgcacgaccggtgctcgatttagtacacacacttagggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggcgaggctgattattactgcagctcatatacaagcagcagcactcaagtcttcggaactgggaccaaggtcaccgtcctaggtcagcccaaggccaacccactgtcta

SEQ ID NO: 783955 - DNA, 509 bp, Homo sapiens
  misc_feature: HIJSMM301DFOJ3.49.28.C06.1.454.light.4.raw
  modified_base (499)..(499): a, c, t, g, unknown or other
agtcgagagacacgaccggtgctcgatttagagctcacgtattgggtttgggggaggaactgctcagttaggacccagacggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatccaccagggcccctggcatcccagccaggttcagtggcagtgggtctgggacagacttcactctcaccatccagcagcttagagcctgaagtattttgctagtttattactgtcagcagcgtatcgaccgggatccaccttcggaccaagggacccacgtggaagattaaggcgaactgtggctgcaccatctgtcttnatccttcccg

SEQ ID NO: 783956 - DNA, 530 bp, Homo sapiens
  misc_feature: HIJSMM301BCDAO.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagcgacacttggggtgttcgggcgggagggaccaggctcgaccgtccgtaaggtcagcccaaggctcgccccctcggtcacctctcgttcccgccct

SEQ ID NO: 783957 - DNA, 507 bp, Homo sapiens
  misc_feature: HIJSMM301EUFHN.9.53.E09.1.454.light.4.raw
tgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattacttgctgctcatatgtcagatggtgacacttcccgtggtattcgggtcggagggaccgaaggtacgaccgtcctaaggtcagcccaaagcct

SEQ ID NO: 783958 - DNA, 529 bp, Homo sapiens
  misc_feature: HIJSMM301DX6B4.51.27.C05.1.454.light.4.raw
cgatcgtatacacgaccggtgctcgatttagacgcgatcgaagggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaaggcaaagcccccaaactcatgatttatgatgtcagtgatcggccctcaggggtttcgaatcgcttctctggctccaagtccggcaacacggcctccctgaccatctctgggctccaggccgaggacgaggctggattattactgcacctcatatacaagcagacaacaaattgggttagttcgggtccggagggaccgaaagctgaccgtcctaggtcacggccaaacggctgccccctcggtccacttctgtt

SEQ ID NO: 783959 - DNA, 460 bp, Homo sapiens
  misc_feature: HIJSMM301BKY16.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctcggtccgaggatgaggctgattattactgtgcagcatgggattacaacctgagtgatcctagttgggtgttcggcggagggaccaggctgaccgtcctaggtcagcccaaggctgccccctcggtcactctgttcccgccctcctcacgtcgtatgt

SEQ ID NO: 783960 - DNA, 519 bp, Homo sapiens
  misc_feature: HIJSMM301AHE76.22.30.C08.1.454.light.4.raw
acatacgcgtcacgaccggtgctcgatttagtctgacgtcaaaagggaaagggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctgggggccgagcgctacctcaccatctccagcctccagtctgaagatgaggctgactattactgtcagacatgggacgctggcgtctggctgttcggcggagggaccaagctgaccgtctaggtcagccaaggctgccccctcggtcactctgttcccgccctcctcacg

SEQ ID NO: 783961 - DNA, 507 bp, Homo sapiens
  misc_feature: HIJSMM301EHDT8.41.53.E09.1.454.light.4.raw
tctatactatcacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagtcagcagctactctgtggtattcgggcggacgggacagctcgaccgtcctaggtctacgtccgaaggctcccgg

SEQ ID NO: 783962 - DNA, 512 bp, Homo sapiens
  misc_feature: HIJSMM301AYZLG.51.10.A10.1.454.light.4.raw
cgatcgtatacacgaccggtgctcgatttagcgtcgatctcaggggcagcttcagctgtgggtagagaagacaggactcaggacaatctccagcatggccagcttccctctcctcctcaccctcctcactcactgtgcagggtcctgggcccaatctgtgctgactcagccaccctcagcgtctgggacccccgggcagagggtcaccatctcctgttctggaagcaactccaacatcggaagttatactgcagactggtaccagcaactcccaggatcggcccccaaactcctcatctatactactaatcaacgggccacaggggtccctgaccgattctccggctccaagtctggcacctcagcctccctggccatcagtggtctccagtctgaggatgaggctcaatacttctgtgcatcatgggatgacagtttgaagttggtccggtggttcggcggagggaccaaacgtcgaccgtccttagtcagcccgaaggctcgtccccccg

SEQ ID NO: 783963 - DNA, 495 bp, Homo sapiens
  misc_feature: HIJSMM301ET9MX.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcaagtgatcaccttcggccaagggcacgactaggagtattaaacgaactgtggctgcaccatctgtctt

SEQ ID NO: 783964 - DNA, 513 bp, Homo sapiens
  misc_feature: HIJSMM301ARD6J.17.33.C11.1.454.light.4.raw
  modified_base (447)..(447): a, c, t, g, unknown or other
cgtagactagcacgaccggtgctcgattttagagtgagctcgttgggtttgggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctatcggnggacgggaccaagctgaccgtcttaagtcagcccaaggctcgccccctcggtcactctcgtcccgt

SEQ ID NO: 783965 - DNA, 483 bp, Homo sapiens
  misc_feature: HIJSMM301BHXL7.51.30.C08.1.454.light.4.raw
  modified_base (464)..(464): a, c, t, g, unknown or other
cgatcgtatacacgaccggtgctcgatttagtctgacgtcaaagggaaaggggctgggcctcaggaagcagcatcggaggtgcctcagccatgacatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggcctccacctctgggaacacagccactctgaccatcagcgggacgcaggctgtggatgaggctgacttttactgtcaggcgtgggacagcgacactgccgtgttcggcggaggaccaagctgaccgtccncggtcagcccaaggctccg

SEQ ID NO: 783966 - DNA, 501 bp, Homo sapiens
  misc_feature: HIJSMM301D03U4.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctctttgttccgtttaatttcggcggagggaccaaggtggagatcaaacgactgtggctgcaccatctgtcttcatcttcccgctat

SEQ ID NO: 783967 - DNA, 466 bp, Homo sapiens
  misc_feature: HIJSMM301AR5QD.41.48.E04.1.454.light.4.raw
tctatactatcacgaccggtgctcgatttagagagcgtcacagagagaaggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagtcaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggaggaccaagctgaccgtcct

SEQ ID NO: 783968 - DNA, 508 bp, Homo sapiens
  misc_feature: HIJSMM301BP510.3.71.G05.1.454.light.4.raw
  modified_base (429)..(429): a, c, t, g, unknown or other
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgngtatattcgggcggagggaccaaggtcgaccggtcctacgtcacgcccaaggtctcgccccctcgggtcactcgttccg

SEQ ID NO: 783969 - DNA, 525 bp, Homo sapiens
  misc_feature: HIJSMM301E4BH7.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctggccagtctgccctgactcagcctgcctccgtgtctgggtctcctggacagtcgatcaccgtctcctgcactgggaccagtaatgattttgaaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggcgtccaggctggaggacggaggctcattactactgctgctcatatggaggttatagcacttgggtgttcggcggcgggacaaagtgaccgtcctaagtcagcccaaggctgcccccgtccgtccgactctcgttcccaccctt

SEQ ID NO: 783970 - DNA, 464 bp, Homo sapiens
  misc_feature: HIJSMM301BC5PE.26.78.H01.1.454.light.4.raw
  modified_base (432)..(432): a, c, t, g, unknown or other
  modified_base (453)..(453): a, c, t, g, unknown or other
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctntcttcatcttcccgccatctnaagtatagtct

SEQ ID NO: 783971 - DNA, 511 bp, Homo sapiens
  misc_feature: HIJSMM301A03X5.48.84.H07.1.454.light.4.raw
agtatacatacacgaccggtgctcgatttagcagacgtctgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcagggcgtgggacagcaacactgcgtagttttcgggcgggggaccaggctggaccggtcggcggtcacgcccgaaggctcgccccctcggtcacctctcgttcccta

SEQ ID NO: 783972 - DNA, 491 bp, Homo sapiens
  misc_feature: HIJSMM301DDTW3.41.39.D06.1.454.light.4.raw
tctatactatcacgaccggtgctcgatttagtgacatctcgcagttctttggggagagaagagctgctcagttaggacccagagggaaccatggaaaccccagcgcagcttctcttcctcctgctactctggctcccagataccaccgaagaaattgtgttgacgcagtctccaggcaccctgtctttgtctccaggagaaagagccaccctctcctgtagggccagtcagattgttagcagcggctacttagcctggttccagcagagacctggccaggctcccaggctcctcatctatgaagcgtccatcaggcccactggcatcccagacagattcagtggcagtgggtctgggacagacttcactctcaccatcagcggactggagcctgaagattttgcagtcttattactgtcagcagtatggtggctcacctccgtactacctttggccgtaggggaccaagcgtaggagatacaaacgaacgt

SEQ ID NO: 783973 - DNA, 508 bp, Homo sapiens
  misc_feature: HIJSMM301E4ALI.18.26.C04.1.454.light.4.raw
tacgagtatgcacgaccggtgctcgatttagtctagcgactttgggtttggggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttattactgccaacattataatacttattcgtacacttttggtccaggggaccaagctggagatacaaacgaaactgtggctgcaccatctgtcttctatccttcccgccta

SEQ ID NO: 783974 - DNA, 519 bp, Homo sapiens
  misc_feature: HIJSMM301B5VK4.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactcggggaccaaggactcaccggtcctacggtcacgcccgaacggacccaaacccccactgtctacc

SEQ ID NO: 783975 - DNA, 500 bp, Homo sapiens
  misc_feature: HIJSMM301D3XZ0.26.26.C04.1.454.light.4.raw
  modified_base (438)..(438): a, c, t, g, unknown or other
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgtcggtttattactgcctgcagagtattnactggccgtggacgttcggaccgaagggaccaagggtaggaaatacaaacgaactagtgcgt

SEQ ID NO: 783976 - DNA, 389 bp, Homo sapiens; identical to SEQ ID NO: 558170
  misc_feature: HIJSMM301BR715.21.40.D07.1.454.light.4.raw

SEQ ID NO: 783977 - DNA, 517 bp, Homo sapiens
  misc_feature: HIJSMM301C1DH6.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctcgccccctcggtcactctcgttcccccg

SEQ ID NO: 783978 - DNA, 516 bp, Homo sapiens
  misc_feature: HIJSMM301ASMD9.8.43.D10.1.454.light.4.raw
  modified_base (494)..(494): a, c, t, g, unknown or other
ctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaaacagacactcctggacccctgcccggttctcaggctcctccttggggccaaagctgccctgacactgtcaggtgtgcagcctgaggacgaggctgagtattactgcctgctctattatggtgggtccttgggtggttcggcgggagggaccgaagctgaccgtcctaggtcagcccaaggctcgccccctcggtcnctctcgttcccaccctcctcgc

SEQ ID NO: 783979 - DNA, 504 bp, Homo sapiens; identical to SEQ ID NO: 566896
  misc_feature: HIJSMM301DKVNN.8.28.C06.1.454.light.4.raw
  modified_base (495)..(495): a, c, t, g, unknown or other

SEQ ID NO: 783980 - DNA, 504 bp, Homo sapiens
  misc_feature: HIJSMM301EYLJ1.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccaggggccactggtactcccagccaggttcagtggcagtgggtctgggacaggagttcactctcaccatcagcagcctgcagtctgaagtattttgcggtttattactgtcagcagtataataactggcctccacggtactacttttgggccagggggaccaagctggagatcaaacgaactgtggctgccacatctgtt

SEQ ID NO: 783981 - DNA, 507 bp, Homo sapiens
  misc_feature: HIJSMM301AK8OO.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctagcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcgagggtacgagtggtggtccgttcgctcgctacgttcgggcgggaggggaccgaagggtagggaggatacaaacgtaa

SEQ ID NO: 783982 - DNA, 511 bp, Homo sapiens
  misc_feature: HIJSMM301BTXDC.48.52.E08.1.454.light.4.raw
agtatacatacacgaccggtgctcgatttagtcgagctctcccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacggaggctgtattattactgcacctcatatacaagcagcagcactctcgtggtattcggcggagggaccaagctgccgtcctaggtcacgcccgaaggcctcgtcccccctcggt

SEQ ID NO: 783983 - DNA, 514 bp, Homo sapiens
  misc_feature: HIJSMM301CFN2J.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcacgtccccatgtgatcgttcggcggggggaccaagctcgaccgtccgtaggtcacgcccaaggctcgtccccccg

SEQ ID NO: 783984 - DNA, 503 bp, Homo sapiens
  misc_feature: HIJSMM301A297O.47.60.F05.1.454.light.4.raw
agctcacgtacacgaccggtgctcgatttagtacgtcatcaggggaaaggggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggcctcctcatctttgatgcgtccaccagggccactggtttcccagccaggttcaggtggcagtgcgtctgcgacagagttcactctcaccatcaacagcctgcagtctgaagtattttgcagttttattactgtcagcagtatcatgactggccgctcaccttcggccgaagggacacgactgggaagaacttaaacgaacgtgtggctgccaccattcttcg

SEQ ID NO: 783985 - DNA, 338 bp, Homo sapiens
  misc_feature: HIJSMM301D6HU7.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatccccagccaggttcagtgg

SEQ ID NO: 783986 - DNA, 514 bp, Homo sapiens
  misc_feature: HIJSMM301ANU64.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaggtcaccgtctaggtcagccaaggccaaccccactgtcactctgttcccaccctcctccgt

SEQ ID NO: 783987 - DNA, 498 bp, Homo sapiens
  misc_feature: HIJSMM301A36YU.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagtattttacactagaaaatcagcagagtggaggctgaggatggttggggtttattactgcatgcaagctctacaaactccttactacttttggccaggggaccaagcgtaggaggatacaaacgaacta

SEQ ID NO: 783988 - DNA, 542 bp, Homo sapiens
  misc_feature: HIJSMM301B3AAB.16.85.H08.1.454.light.4.raw
tgtactactccacgaccggtgctcgatttagtatcactcagtcgcggggcgtgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcgggatgaggccgactattactgtcaggtggtgggagtggtgttagtgagtcgggctacgttttcggcgggtacgggacccagcgtgaccgtccgtaggtcacgcccgaaggcctcgcccccgtcggtccgtactctcgttcccaccctcctcgagttaacg

SEQ ID NO: 783989 - DNA, 513 bp, Homo sapiens
  misc_feature: HIJSMM301AZOJW.48.38.D05.1.454.light.4.raw
  modified_base (497)..(497): a, c, t, g, unknown or other
agtatacatacacgaccggtgctcgatttagtatctgatagttgggtttggggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagacgcccgaagtattttgcggtttattactgtcagcagcgtgccaactggcctctcaccgttcgggccggagggaccgaaggtcggacatacaaacgaactgtggcctgccaccatctntcttcactccttcccg

SEQ ID NO: 783990 - DNA, 508 bp, Homo sapiens
  misc_feature: HIJSMM301A600V.2.35.D02.1.454.light.4.raw
acgctcgacacacgaccggtgctcgatttagcacacgatagttgggtttgggggtctcaggaggcagcgctctcaggacgtcaccaccatggcctgggctctgctccccctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtccgtgggtcagcccaaggctcgccccctcggtccact

SEQ ID NO: 783991 - DNA, 512 bp, Homo sapiens
  misc_feature: HIJSMM301EXUF8.43.34.D01.1.454.light.4.raw
tgtgagtagtcacgaccggtgctcgatttagatcgtctgtgttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacgccaccctgaccgtctctgggctccaggctgaggatggaggctcattattactgcagctcaattatacaggacaacaagtaatttggtggttcgggcggagggaccgagctgaccgtcctaggtcacgccaaggctcgccccctcggt

SEQ ID NO: 783992 - DNA, 483 bp, Homo sapiens
  misc_feature: HIJSMM301EM7MR.21.25.C03.1.454.light.4.raw
  modified_base (382)..(382): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccaatgctggagattgtcctgagtgctgcctcttgtgcccacagctgaagcagagcctccaaactcctcatctatggtaacagcaatcggccctcaggggtccctgaccgattctctggctccaagtctggcacctcagccnccctggtcatcgctgggctccaggcctgacgatgaggctgattattattgcagtcctaatgacaacaaccctgcgtggttttgtcgtgttcggtggcgggc

SEQ ID NO: 783993 - DNA, 517 bp, Homo sapiens
  misc_feature: HIJSMM301D51OG.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtcggccgtccgggggccacgtttccggcccgttcgggacccaaagtaggatatacaaaccgaactagtggctgcaccatctgtctt

SEQ ID NO: 783994 - DNA, 498 bp, Homo sapiens
  misc_feature: HIJSMM301B8OCC.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggcgtgaggacgttggggtttattactgcatgcaaggtctacaaaccccgatcaccttcggccgagggacacgcctggagaattaacgaactgtgctgcaccat

SEQ ID NO: 783995 - DNA, 495 bp, Homo sapiens
  misc_feature: HIJSMM301ESNS4.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgctaacttactactgtcagcaggctaacacggctcgcccccaaccttccggccgtaggggacaacggactggaagattaaacgaactgtggctgcacatctcgtt

SEQ ID NO: 783996 - DNA, 498 bp, Homo sapiens
  misc_feature: HIJSMM301D2B2V.40.34.D01.1.454.light.4.raw
  modified_base (441)..(441): a, c, t, g, unknown or other
tctagcgactcacgaccggtgctcgatttagatcgtctgtgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggtctacttattttgctgctcttaatgcaggctagttcnctctcgaagtgttcggcggaggaccgagctgccgtcctacgtcacgccaaggctccg

SEQ ID NO: 783997 - DNA, 505 bp, Homo sapiens
  misc_feature: HIJSMM301AVQNN.3.33.C11.1.454.light.4.raw
agacgcactccacgaccggtgctcgatttagagtgagctcgttggggtttggggggggtctcaggaggcagcgctctcaggacgtcaccaccatggccctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatagcaggcatcaacactgttttcggcggtagggaccaagcttgaccgtcctaggtcagacccaaggctcgtcccccg

SEQ ID NO: 783998 - DNA, 383 bp, Homo sapiens; identical to SEQ ID NO: 447524
  misc_feature: HIJSMM301DN1IV.41.26.C04.1.454.light.4.raw

SEQ ID NO: 783999 - DNA, 495 bp, Homo sapiens
  misc_feature: HIJSMM301DF63U.48.37.D04.1.454.light.4.raw
agtatacatacacgaccggtgctcgatttagtagcatactgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcgccctcaggggtccctgatcgcttctctggctccaagtctggcaacacggcctccctgccgtctctgggctccaggctgaggatgaggctgattatactgcagctcatatgcaggcagcaacaatgtggtattcggcggagggccaagctgaccgtcctaggtcagcccaaggctccg

SEQ ID NO: 784000 - DNA, 521 bp, Homo sapiens
  misc_feature: HIJSMM301CFZS5.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccgaaggtaggaagtacgaacgacgaactgtggctgcaccattactcgtcttcatcttcccgtcctact

SEQ ID NO: 784001 - DNA, 521 bp, Homo sapiens
  misc_feature: HIJSMM301B00KC.49.10.A10.1.454.light.4.raw
agtcgagagacacgaccggtgctcgatttagcgtcgatctcagggggcgtgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaaggcctgccccctcggcactctcgtcccaccctcctctctctcg

SEQ ID NO: 784002 - DNA, 496 bp, Homo sapiens
  misc_feature: HIJSMM301BIA9Q.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtagaaatcaaacgaactgtggctgcacc

SEQ ID NO: 784003 - DNA, 519 bp, Homo sapiens
  misc_feature: HIJSMM301C1ISJ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagccaaggctgcccctcggtcactctgttcccacctt

SEQ ID NO: 784004 - DNA, 522 bp, Homo sapiens
  misc_feature: HIJSMM301B8VXJ.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacaggacttcactctcaccatcatcagcctggagcctgaagatgttgcagtttattactgtcaacatcgtaccgagtcggccgtccggggcctacgtttcggcccgtgggaccgaaggtaggagagtacaaacgaacctagtggctgccaccactctgtcttcgta

SEQ ID NO: 784005 - DNA, 486 bp, Homo sapiens
  misc_feature: HIJSMM301CHYC4.41.23.C01.1.454.light.4.raw
tctatactatcacgaccggtgctcgatttagtacacgtgattagggattgggggctgtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccatcagggatacctgagcgtatgtctggctccagctcagggacaacagtcacgttgaccatcactggagtcaggcagaagacgaggctgactatcactgtcaatcaagcagacaggtagtggttcttagttgggtgttacggcgggagggaccaagctggaccgtcttggtcacgccc

SEQ ID NO: 784006 - DNA, 522 bp, Homo sapiens
  misc_feature: HIJSMM301DPKBR.43.67.G01.1.454.light.4.raw
tgtgagtagtcacgaccggtgctcgatttagagtatacatattggggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtcctgaccgattccgtggcagcgggtctggggacagacttcactctcaccatcagtagcctgcagcctgaagatgtggcaacttattactgtcaacaatttcgttatactccgccgacgttcggtccgggggaccaccggtcggaaatacgaaacgaacgtcgtggcgtggtcaccactcctgtcgtt

SEQ ID NO: 784007 - DNA, 494 bp, Homo sapiens
  misc_feature: HIJSMM301E35GQ.22.86.H09.1.454.light.4.raw
acatacgcgtcacgaccggtgctcgatttagtgctatagacttgggtttgggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccagctgagatgaggctgattattaactgctgctcatttgctaggcgcctacaccttggttgttcgggtcggaggggaccaaagctgaccgtcctaggttcagccc

SEQ ID NO: 784008 - DNA, 501 bp, Homo sapiens
  misc_feature: HIJSMM301CFRW0.4.39.D06.1.454.light.4.raw
  modified_base (390)..(390): a, c, t, g, unknown or other
  modified_base (445)..(445): a, c, t, g, unknown or other
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcttataactatgtctcctggtaccaacaacacccaggcaaagcccccaaattcataatttatgaggtcactaagcggccctcaggggtccctgatcgcttctctgcctcaaggctggcaacacggcctccctgaccgtctctgggctccnggctgaggatgaggctgattattattgcagctcatatgcaggcagttacaatgtnatattcgggcggagggaccaaactgaccgtcaggtcagcccaaggctgcccccttc

SEQ ID NO: 784009 - DNA, 497 bp, Homo sapiens
  misc_feature: HIJSMM301DDXTQ.3.33.C11.1.454.light.4.raw
agacgcactccacgaccggtgctcgatttagagtgagctcgttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgaattataactatgtctcctggtaccagcagcacccaggcaaagcccccaaactcatgatttatgaggtcacaaaagcggccctcaggggtccctgatcgcttctctgcctccaagtctggcaacacggcctccctgaccgtctctgggctccagcctgaggatgaggctgattattactgcagctcatatgcaggcatcaacactaggttttcggtcgggagggaccaagctgaccgtcctaggtcagcccaaggct

SEQ ID NO: 784010 - DNA, 504 bp, Homo sapiens
  misc_feature: HIJSMM301DKOYX.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctgctccaagtctggcaacacggcctccctgacaatctctgggctccaggctgacgacgaggctaattattactgctgctcatatgaaggttataacactatactattcggcggagggaccaagctgaccgtcctgcgtcacgcccaaggctcgccccctccggtccact

SEQ ID NO: 784011 - DNA, 505 bp, Homo sapiens
  misc_feature: HIJSMM301B11XO.18.78.H01.1.454.light.4.raw
  modified_base (468)..(468): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgtttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacagcagcagcactcaagtcttcggaactgggaccaggcnccgtacctaggtcagcccaaggccaacccactgtcta

SEQ ID NO: 784012 - DNA, 486 bp, Homo sapiens
  misc_feature: HIJSMM301C0ADF.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacaggacttcactctcaccatcagcagactggagcctgaagattttgcagtctattactgtcagcagtatggtcacgtccaagaactttaggtccagggaccaagctggagatcaaacgaactgtggctgcaccat

SEQ ID NO: 784013 - DNA, 526 bp, Homo sapiens
  misc_feature: HIJSMM301EUTSY.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcggcggagggaccaggctgaccgtcctaggtcagcccaacggctcgccccctcggtcactctgttcccgcccttccc

SEQ ID NO: 784014 - DNA, 475 bp, Homo sapiens
  misc_feature: HIJSMM301DMMJW.11.70.G04.1.454.light.4.raw
  modified_base (391)..(391): a, c, t, g, unknown or other
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcagggtcccatctcgattcagtggcagtcggatctgggacagatttcactctcaccatcagcagcctgcagcctgaanatgttgcaacttattactgtacaaaagaatagcgctcgcccccgctcagtttccggcggtagggaccgaaggtggagataaccg

SEQ ID NO: 784015 - DNA, 487 bp, Homo sapiens; identical to SEQ ID NO: 593817
  misc_feature: HIJSMM301DUXH6.47.70.G04.1.454.light.4.raw

SEQ ID NO: 784016 - DNA, 504 bp, Homo sapiens
  misc_feature: HIJSMM301AK6D9.48.67.G01.1.454.light.4.raw
agtatacatacacgaccggtgctcgatttagagtatacatattgggttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctggggacagacttcactctcaccatcagcagcctagagcccgaagattttgcggtttatactgtcagcagcgtcgccaactggcctctcacggttcggcgggagggaccaaggtggacatacaaacgaactgtggctgcaccatctgtctcatcctcccg

SEQ ID NO: 784017 - DNA, 374 bp, Homo sapiens
  misc_feature: HIJSMM301EBLP3.40.60.F05.1.454.light.4.raw
tctagcgactcacgaccggtgctcgatttagtacgtcatcaggggaaagggccaccctctcctgcagggccagtcagagtgtaaccaacaactacttaatgtggtaccagcaaaaacctggccaggctcccaggctcctcatctatggtgcatccaacagggccagtggcatcccagacaggtttagaggcagtggggccgacacagacttcactctcaccatcagcagactggagcctgaagattttgcactgtattactgtcaccagtctgctcacgtacctctcactttcggcggagggaccaaggtggagatcaaacgaactgtggctgcaccatctgtcttcatcttcccgccatctgaagtcgctaga

SEQ ID NO: 784018 - DNA, 506 bp, Homo sapiens
  misc_feature: HIJSMM301AX5UI.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacattttcaccctcaccatcaatagcctggaagctgaagatgctgcaacttattactgtcatcagatactacctttacctctaatgatcaccttcggccgacggacgacgactaggagataaacg

SEQ ID NO: 784019 - DNA, 504 bp, Homo sapiens
  misc_feature: HIJSMM301EUPOI.21.81.H04.1.454.light.4.raw
  modified_base (440)..(440): a, c, t, g, unknown or other
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgagctgattatactgcaggtcatatacaatcagcaacacttangtcttcgggactcgggaccaagatcaccgtcctaggtcagcccaaggaccaacccccactgtca

SEQ ID NO: 784020 - DNA, 519 bp, Homo sapiens
  misc_feature: HIJSMM301AT0ZU.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagttttatttcttgtcagcagtctgaagactggccgttcactttcggcgggagggaccgaaggtggacctacaaacgaactgtggctgcaccatctcgtcttcacttccttccccgccatcc

SEQ ID NO: 784021 - DNA, 514 bp, Homo sapiens
  misc_feature: HIJSMM301C5US0.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaagctgccctgacactgtctggtgtgcagcctgaggacgaggctgactattactgcctactcttactttggtggtgctgtgctattcggcggagggaccaagctgaccgtcttaagtcagcccaaggctcgccccctcggtcactctcgttccccgt

SEQ ID NO: 784022 - DNA, 500 bp, Homo sapiens; identical to SEQ ID NO: 542309
  misc_feature: HIJSMM301A9Y0R.12.86.H09.1.454.light.4.raw

SEQ ID NO: 784023 - DNA, 521 bp, Homo sapiens
  misc_feature: HIJSMM301BQY9E.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacactgggtgttcggcggagggaccaagggctgaccgtcctaggtcagcccaaggctgccccctcggtcactctgttcccacct

SEQ ID NO: 784024 - DNA, 495 bp, Homo sapiens
  misc_feature: HIJSMM301AUJ4R.47.38.D05.1.454.light.4.raw
  modified_base (429)..(429): a, c, t, g, unknown or other
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagttggatcaggcacagattttacgctgaaaatcagtagggtggaggctgaggatgtttggggtttattactgcntgcaagttctactaaacttacctactacttttggtccaggggaccaaaggctggagatcaaacgaa

SEQ ID NO: 784025 - DNA, 506 bp, Homo sapiens
  misc_feature: HIJSMM301EJOVU.19.78.H01.1.454.light.4.raw
  modified_base (441)..(441): a, c, t, g, unknown or other
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctnttatgtcttcggaactggaccaaggtcaccgtctaggtcacgcccaaggccaaccccactgtcta

SEQ ID NO: 784026 - DNA, 500 bp, Homo sapiens
  misc_feature: HIJSMM301BMF3C.48.39.D06.1.454.light.4.raw
  modified_base (481)..(481): a, c, t, g, unknown or other
  modified_base (491)..(491): a, c, t, g, unknown or other
agtatacatacacgaccggtgctcgatttagtgacatctcgcagttctttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtagtggtagctacaccgatcaccttccggccaagggacacgactggagacttaaccgaactgnggctagcacntactgtctt

SEQ ID NO: 784027 - DNA, 511 bp, Homo sapiens
  misc_feature: HIJSMM301DOA0N.9.53.E09.1.454.light.4.raw
tgatacgtctcacgaccggtgctcgatttagagagagtgtgttgggtttgggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagccggccctcaggggtttctattcgcttctctggctccaagtctgacaacacggcctccctgacaatctctgggctccaggctgaggacgaggctgattattactgctgctcatatgcagatggtgacactcccgtggtattcgggcggagggaccaaggtgaccggtcctaggtcagcccaaggctcggtccccccg

SEQ ID NO: 784028 - DNA, 494 bp, Homo sapiens
  misc_feature: HIJSMM301CPCDS.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcacgcccaacggcccaaccccactcg

SEQ ID NO: 784029 - DNA, 491 bp, Homo sapiens
  misc_feature: HIJSMM301A3452.22.65.F10.1.454.light.4.raw
  modified_base (316)..(316): a, c, t, g, unknown or other
  modified_base (483)..(483): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtnaaggttcagtggcagtggatctgggacagatttcactctcaccatccgcggtctgcaacctgaagattcgcaacttactactgtcaacagacttacagtcgcccccccgatccaccttcgccaagggacacgactggagattaaacgaactgtggctgcaccatctntcttcatt

SEQ ID NO: 784030 - DNA, 453 bp, Homo sapiens
  misc_feature: HIJSMM301ELQHL.43.55.E11.1.454.light.4.raw
tgtgagtagtcacgaccggtgctcgatttagcactcgcacgttgggtttgggggcttgtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaatcatgatttatgaggtcaataagcggccgtcaggggtccctgatcgcttctctggctccaagtctggcaacacggcaccctgaccgtctctgggctccaggctgaggatgaggctcattatactgcagctcatatacaggcaacaagaatttggtgttcggcggagggaccgagctgaccgtcctaggtccagcccaaggctgccccctcggtcacgctgttacccgccctcctcactactcaca

SEQ ID NO: 784031 - DNA, 488 bp, Homo sapiens
  misc_feature: HIJSMM301CNNB8.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagccctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggaggaccaaggttgagatcaaacgaactgtggctggcacc

SEQ ID NO: 784032 - DNA, 493 bp, Homo sapiens
  misc_feature: HIJSMM301EDZAT.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatcttatgtcttcggatcgtggaccaagggtcaccgtccgtaggtcagcccgaaggacccaacccc

SEQ ID NO: 784033 - DNA, 530 bp, Homo sapiens
  misc_feature: HIJSMM301AQRSY.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcaagcggcagtgggtcagacactgacttcacactgagaatcagcagggttgaggctgagatgttggcacttattactgcatgctaaggctcacactcggcctccgtggacggttcggccgaaacgggaccggggtacggaaaagtaaaaacgaaactagtggctgcaccactctgttcttctattcccg

SEQ ID NO: 784034 - DNA, 494 bp, Homo sapiens
  misc_feature: HIJSMM301CBB3X.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggatccctgagcgattctctggctccaggtcagggacaacggtcacattggccatcagtggagtccaggcagaggacgaggctgactattattgtcaatcaacagacaccattggtacttatggtcttggaactgcgaccaaggtcaccgtcctgggtcagcccaaggccaacccactgtcta

SEQ ID NO: 784035 - DNA, 517 bp, Homo sapiens
  misc_feature: HIJSMM301AROOH.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccagtctggcacacggcctccctgaccgtctctgggctccaggctgacgatgaggctgattattactgcagctcacatgcagtccagtaacaattttcgggggttttcggcgggtagggccaagctgaccgtctaagtcaggcccaaggctcggccccctcggtccactctccg

SEQ ID NO: 784036 - DNA, 508 bp, Homo sapiens
  misc_feature: HIJSMM301B8H0S.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacatctctgggctccaggctgaggacgaggctgattactactgctgctcatatgcaggtcgtatctcttatgtcttcggaacgtgggaccaaggtccaccgtcctaggtcagcccaaggcccaacccactgtcta

SEQ ID NO: 784037 - DNA, 521 bp, Homo sapiens
  misc_feature: HIJSMM301CRPHR.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagtattttgcaacttactactgtacaacagagttcagtcgtcccccggacgtcggtccgacgggaccgacacgtagaaatagtagacgaactagtggtcgtggtcacctactacttgtcttctacttcttcccgt

SEQ ID NO: 784038 - DNA, 494 bp, Homo sapiens
  misc_feature: HIJSMM301D3A6C.4.24.C02.1.454.light.4.raw
agcactgtagcacgaccggtgctcgatttagtacagatcgttaggggaaagggggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaactgatgatgttgctaacttattactgtacaacaataataacagttattggacgttcggccaagggaccaaggtagaaatcagacgactagtggctgcacatctgtctcta

SEQ ID NO: 784039 - DNA, 499 bp, Homo sapiens
  misc_feature: HIJSMM301AFWU0.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcgggagggaccaagctgaccgtcctaggtcagccccaaggctcgccccctcggtcactctcgttccccaccctcctcgctacgtaga

SEQ ID NO: 784040 - DNA, 500 bp, Homo sapiens
  misc_feature: HIJSMM301B061F.19.78.H01.1.454.light.4.raw
  modified_base (463)..(463): a, c, t, g, unknown or other
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctggctccaggctgaggacgaggctgattactactgctgctcagtatgcaggtcgtatctcttatgtcttcggaactgggaccaaggtcaccgtctaggtcacgccaaggcccaacccnctagtcactctcgttcccgccctcctccacgagagta

SEQ ID NO: 784041 - DNA, 355 bp, Homo sapiens; identical to SEQ ID NO: 745205
  misc_feature: HIJSMM301DRZSR.19.22.B11.1.454.light.4.raw

SEQ ID NO: 784042 - DNA, 496 bp, Homo sapiens
  misc_feature: HIJSMM301DTERQ.41.45.E01.1.454.light.4.raw
tctatactatcacgaccggtgctcgatttagtgagtcagtaagggaaaggggggtgtgggtccaggaggcagaactctgggtgtctcaccatggcctggatccctctacttctccccctcctcactctctgcacaggctctgaggccgcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagcccaaggctgcccccgtcg

SEQ ID NO: 784043 - DNA, 524 bp, Homo sapiens
  misc_feature: HIJSMM301AEBYL.10.38.D05.1.454.light.4.raw
catagtagtgcacgaccggtgctcgatttagtatctgataggttggggtttggggggggtctcaaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggcctcgccccctggtccactctcgttcccaccct

SEQ ID NO: 784044 - DNA, 521 bp, Homo sapiens
  misc_feature: HIJSMM301AW1NJ.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggcctccctccttggggcaaagctgccctgacactgtctggtgtgcagcctgaggacgaggctgactattactgcctactcttactttggtggtgctgtgctagttcgggcgggaggaccaagctgaccgtcttaagtcagcccaaggctcgccccctcggtcactctcgttccccaccctccct

SEQ ID NO: 784045 - DNA, 519 bp, Homo sapiens
  misc_feature: HIJSMM301BM4MP.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacggaggctgattattactgccactcatatagaagtagtactactcctgtggttttcggtcggagggaccaagctgaccgtcctaggtcacgcccaaggctcgccccctccggtcactctgttccccc

SEQ ID NO: 784046 - DNA, 504 bp, Homo sapiens
  misc_feature: HIJSMM301EJKOW.21.38.D05.1.454.light.4.raw
  modified_base (199)..(199): a, c, t, g, unknown or other
tcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactgcgcctgaagattttgcagtgtattactgtcagatgtatggtaggtcaccgtacacctttggccaggggaccaaggtggagatcagacgaactagtggctgcaccatctgtcttcatccttcccg

SEQ ID NO: 784047 - DNA, 489 bp, Homo sapiens
  misc_feature: HIJSMM301BEOGG.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgtcgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccgaaggtggagatcaaacgaactgtggctgcaccatctgtcttcattcc

SEQ ID NO: 784048 - DNA, 497 bp, Homo sapiens
  misc_feature: HIJSMM301AVFF2.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctcgggtcccagacagattcagcggcagtggcactgatgtcacactgacaatcagcagggtggaggctgaggatgttggggtttgttcctccatgcaaggtacacactggtccttttggccacggggaccgaacctcggagatcaaatgaactgtggctgcaccatctgtctt

SEQ ID NO: 784049 - DNA, 514 bp, Homo sapiens
  misc_feature: HIJSMM301EEREU.43.23.C01.1.454.light.4.raw
tgtgagtagtcacgaccggtgctcgatttagtacacgtgattagggattggggggggtctcaggaggcagcgccctcgggacgtctccaccatggcctgggctctgctattcctcaccctccccactcagggcacagggtcctgggcccagtctgccctgactcagcctgcctccatgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctcaggctgaggacgaggctgattattactgcagctcatatacaagcagcagcacttatgtcttcggaacttgggaccaaggtcacccgactagggtcacgcccaaggcccaaacccccacgtcgtcta

SEQ ID NO: 784050 - DNA, 515 bp, Homo sapiens
  misc_feature: HIJSMM301AKL3I.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtcggccgtccgggggcctacctttccggcccgtcgggaccgaaaggtaggagatacaaacgaactagtggctgcaccta

SEQ ID NO: 784051 - DNA, 485 bp, Homo sapiens
  misc_feature: HIJSMM301DQ9VV.21.25.C03.1.454.light.4.raw
  modified_base (360)..(360): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggcncaagtctggcacctcagcctccctggtcatcgctgggctccgaggctgacgatgaggctgatttattattgccagtcctatgacaaccaccctgcgttggttttggtctgttcggcggcgggacc

SEQ ID NO: 784052 - DNA, 377 bp, Homo sapiens; identical to SEQ ID NO: 536071
  misc_feature: HIJSMM301APF7Q.40.9.A09.1.454.light.4.raw

SEQ ID NO: 784053 - DNA, 509 bp, Homo sapiens
  misc_feature: HIJSMM301DC43H.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggccccctcacgttcggcggagggaccaaggtggacatcaaacgaactgtggctgcaccatctgtcttcattccttcccgcct

SEQ ID NO: 784054 - DNA, 555 bp, Homo sapiens
  misc_feature: HIJSMM301CX8H7.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctgggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgaggtcggccgtcccgggggcctaccgtttccggccccgtcggggaacccgaaacggtacggaagtattaccaaaacggtaaacgttacgtgggcgttcggccaccaactcttcgttcgtttccta

SEQ ID NO: 784055 - DNA, 510 bp, Homo sapiens
  misc_feature: HIJSMM301B2KA9.16.78.H01.1.454.light.4.raw
  modified_base (504)..(504): a, c, t, g, unknown or other
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagtcagtataataactggcctccacggtacactttttggccgtagggggaccaaacgctggagatacaaacgaactagtgggctggcacccancttgtt

SEQ ID NO: 784056 - DNA, 498 bp, Homo sapiens
  misc_feature: HIJSMM301BYCU0.11.59.F04.1.454.light.4.raw
  modified_base (390)..(390): a, c, t, g, unknown or other
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctcaagtctggcacacggcctccctgaacatctctgggctccaggctgnggatgaggctgattattattgctgcttcatatggaagtacctactcttttctcttcggaacttgggaccacggtcaccgtcctaggtccagcccaaggcccaaccccc

SEQ ID NO: 784057 - DNA, 494 bp, Homo sapiens
  misc_feature: HIJSMM301ERZK3.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttattctgtctgcagtacaatcagtggcctcggacgttcggccaagggaccaaaggtcggaaatacaaaacgaactagtggctgcaccatctgtcttcta

SEQ ID NO: 784058 - DNA, 513 bp, Homo sapiens
  misc_feature: HIJSMM301ETZG3.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcgggcggggggaccaagctgaccgtcctacggtcacgcccaaggcctcgtccccccg

SEQ ID NO: 784059 - DNA, 514 bp, Homo sapiens
  misc_feature: HIJSMM301BJA8F.40.59.F04.1.454.light.4.raw
tctagcgactcacgaccggtgctcgatttagtacacacacttagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgagactttgcagtttattactgtcagcagcgtaccaactggccgctcacctttcggcggagggaccgaacggtgggacgtatacgaaaccgaacttgtcggctggccaaccatcttagtctttcactt

SEQ ID NO: 784060 - DNA, 490 bp, Homo sapiens
  misc_feature: HIJSMM301APH3L.3.33.C11.1.454.light.4.raw
  modified_base (379)..(379): a, c, t, g, unknown or other
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtntctgggctccagcctgaggatgaggctgattattactgcagctcatatgcaggcatcaacactgttttcggcggagggaccaagctgaccgtcctaggtcagtccaaggct

SEQ ID NO: 784061 - DNA, 510 bp, Homo sapiens
  misc_feature: HIJSMM301CDI9L.47.85.H08.1.454.light.4.raw
  modified_base (417)..(417): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcacttctctggctccaaatctggcaacacggcctccctgaccatctctgggctcgagtctgaggacgaggctgattacttctgttgntcttgggcaactactgtcgtttgggtgttcggcggagggaccaagttcgacgtcctaggtcagccaaggctcgccccctcggtcactctcgtt

SEQ ID NO: 784062 - DNA, 482 bp, Homo sapiens
  misc_feature: HIJSMM301DZ3QP.4.34.D01.1.454.light.4.raw
  modified_base (412)..(412): a, c, t, g, unknown or other
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaactggccaggctcccaggctcctcatctatggtgcatccaccagggccactggtatcccagccaggttcagtgccagtgggtctgggacagagttcactctcaccatcagcagcctgcagtctgaagattttgcggtttattactgtacngcagtatgatactggctgtacactttgccaggggaccaagctggagatcaggcgaactgtggctgcaacc

SEQ ID NO: 784063 - DNA, 500 bp, Homo sapiens
  misc_feature: HIJSMM301DMI0V.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggtttccagcagaaaccaggacatcctcctctactgctcatttactgggcgtctacccgggaatccggggtccctgaccgattcagtggcagcgggtctgggacagatttcactctcaccatcagcagcctgcaggctgaagatgtgcagtttattactgtcagcaatattatattcctcctcagacgttccggccgaagggaccaagggtcggtaaatccaaaacgaactagtggc

SEQ ID NO: 784064 - DNA, 507 bp, Homo sapiens
  misc_feature: HIJSMM301DGNCP.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggaggaccaaactgaccgtctaggtcacgcccgaaggcctcgcccccgttc

SEQ ID NO: 784065 - DNA, 509 bp, Homo sapiens
  misc_feature: HIJSMM301D3JT3.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagattttttataagtatgtctcctggtaccaacaacgcccaggcaaagcccccaagctcatgatttatgaggtcattaagcggccctcaggggtccctcatcgcttctctggctccaagtctggcaacacggcctcctgaccgtctctgggctccaggctgaggatgaggctacttattactgcagttcattatgcagacagcaacaatttcattattcggcggagggaccaggctgaccgtcctgggtcagcccaaggctcgccccctcggtcacctctcgttccccgccctcctccgt

SEQ ID NO: 784066 - DNA, 443 bp, Homo sapiens
  misc_feature: HIJSMM301ADY99.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagccaaggctgccccctcggtcactctgttcccgccctcctcgtactagacg

SEQ ID NO: 784067 - DNA, 495 bp, Homo sapiens
  misc_feature: HIJSMM301BGPD5.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggaggggaccaggggtggaggatcaaacgaactgtggctgcaccatctgtcttcat

SEQ ID NO: 784068 - DNA, 514 bp, Homo sapiens
  misc_feature: HIJSMM301D8PHV.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggcgaggctgactattactgcctgctcatatatggtggcgcgtgggtgttcggcggagggaccaagctgaccgtcctgggtcagcccaggcctgccccctcggtcactctcgttcccgccct

SEQ ID NO: 784069 - DNA, 423 bp, Homo sapiens
  misc_feature: HIJSMM301EC8E9.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagccctccctggccatcactgggctccaggctgaggatgaggctgactattgctgccagtcgtatgacagtggcctaagtaacatcgtcttcggaactgggaccaaggtcaccgtcctgggtcagcccaaggccaaccccactgtcactctgttcccaccctcctcagacgtatca

SEQ ID NO: 784070 - DNA, 518 bp, Homo sapiens
  misc_feature: HIJSMM301AW7OY.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacagggggctgattattaactgtcagctccatatgcagttggttccgttctttcaagtatattcggtcggagggaccgaggctgaccgtcctgagtcagacccaacggctcgtccccccg

SEQ ID NO: 784071 - DNA, 511 bp, Homo sapiens
  misc_feature: HIJSMM301C81X8.48.73.G07.1.454.light.4.raw
agtatacatacacgaccggtgctcgatttagctctacgctcagggcacgaccggtgctcgatttagatcgtctgtgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggcccaggctcccagactcctcatctatgatgcgtctaccagggccactggcgtcccggccaggttcagtgccagtgggtctgggacagacttcactctcaccatcagcagccctagagccccgaagattttgcggttttattactgtcagcagcgtgccaatggcctctcacgttcggcggagggaccaaggtggacatcaaacgtaac

SEQ ID NO: 784072 - DNA, 513 bp, Homo sapiens
  misc_feature: HIJSMM301D2UOG.19.85.H08.1.454.light.4.raw
tactctcgtgcacgaccggtgctcgatttagtatcactcagtcggcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctccaaactcctgtcgtacaggaatgacaaccggccctcaaacatttcagagagattttctacctccaggacacaaaatacagcctctctgaccattactggtctccagcctgacgacgaggctgactactactgctcagcctcggacaccagcctcgctcgcttggtcttttcgggcggagggaccgaagctgacccgtctcgggtcagcccgaaggctcgcccccgtcgtacc

SEQ ID NO: 784073 - DNA, 514 bp, Homo sapiens
  misc_feature: HIJSMM301A0QZ3.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctcgccccctcggtccactctgttcccgt

SEQ ID NO: 784074 - DNA, 507 bp, Homo sapiens
  misc_feature: HIJSMM301DGM3I.18.78.H01.1.454.light.4.raw
tacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttgggtggttatactatgtctcctggtaccaacagcacccaggcaaagccccaaactcatgatttatgatgtcagtaatcggccctcaggggtttctaatcgcttctctggctccaagtctggcaacacggcctccctgaccatctctgggctccaggctgaggcgaggctgattattactgcagctcatatacaagcagcagcactcaagtcttacggaactgggaccaaggtcaccgtcctaggtcagcccaaggccaaccccgatcgtca

SEQ ID NO: 784075 - DNA, 462 bp, Homo sapiens
  misc_feature: HIJSMM301AK04H.13.4.A04.1.454.light.4.raw
  modified_base (428)..(428): a, c, t, g, unknown or other
  modified_base (449)..(449): a, c, t, g, unknown or other
  modified_base (453)..(453): a, c, t, g, unknown or other
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagtattttactttcaccatcagcagcctgcagcctgaagtatattgacaacattattactgtcagcagtatgatatctccntcacttcgcaaggacacgacngganattaaacga

SEQ ID NO: 784076 - DNA, 495 bp, Homo sapiens
  misc_feature: HIJSMM301ANHKT.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgctagtttattactgtcagcagtatgatacctggcctccgtacacttttggccggggaccaagctggaaatcaagcgaactgtggctgcaccatctgtcttcattcc

SEQ ID NO: 784077 - DNA, 505 bp, Homo sapiens
  misc_feature: HIJSMM301BQVUW.13.36.D03.1.454.light.4.raw
  modified_base (311)..(311): a, c, t, g, unknown or other
tcacgtactacacgaccggtgctcgatttagctgcgtcacgatctctcgttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctgggccaggctcccaggctcctcatttntggtgcatccactagggccatggtgtcccagtcaggttcagcggcagtgggtctgggacagacttcactctcaccatcagcagcctgcagtctgaagattttgcagtctattactgtcagcagtatagttactaggacgtaaccttcggacgacggaacggacgaccgtagaggtaagtaaggtaaacggttaa

SEQ ID NO: 784078 - DNA, 483 bp, Homo sapiens
  misc_feature: HIJSMM301A7L6U.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcagtcaagacactgacaagtttgtgaattggtatcagcagaaaacagggacagcccctaagctcctaatctacgatgcgtctcatttgcagacagggtcccaccaaggttcagcggaagtggatctgggacagattttaatttcaccatcagcagcctccaacgtgatgatgttgcaacatactattgtcagcaatatgattttgctcctccgagtgcctacgttttcgggcggggggaccgaaggtacggacgatacaaacgaacttc

SEQ ID NO: 784079 - DNA, 500 bp, Homo sapiens
  misc_feature: HIJSMM301C7N4Q.22.27.C05.1.454.light.4.raw
  modified_base (406)..(406): a, c, t, g, unknown or other
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagangtggcagtttattactgtcagcaatattatattcctcctcagacgttcggccaagggaccaaggtggaaatcaaacgaactgtggctgcaccta

SEQ ID NO: 784080 - DNA, 525 bp, Homo sapiens
  misc_feature: HIJSMM301D5H6D.8.42.D09.1.454.light.4.raw
ctcgcgtgtccacgaccggtgctcgatttagacacatacgcagggaaagggggggggtctcaggaggcagcgctctcaggacgtcacccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctcctgaccgtctctgggctccagactgaggatgaggctgattattactgcagctcagtattcaggcagcaacagggtattcggcggacgggaccaaggttcgaccgtccgtaggtccagccccgaaggctacgcccccgtcggtctactcctcgttccccaccctt

SEQ ID NO: 784081 - DNA, 516 bp, Homo sapiens
  misc_feature: HIJSMM301ECK8N.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagtattttgcaacttactactgtcaacagagtttcagtcgtcccccggacgtcgtccgacgggaccgacgagtagaaatagagacgaacgtacgtggcgtgcaccgaatctcgtcttctactcttcccgt

SEQ ID NO: 784082 - DNA, 478 bp, Homo sapiens
  misc_feature: HIJSMM301DMATB.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagccctaagctcctaatctacgatgcgtctcatttgcagacaggggtcccaccaaggttcagcggaagtggatctgggacagatttaatttcaccatcagcagcctccaacgtgatgatgttgcaacatactattgtcagcaatatgaatttgtctcctcgagtgccacgttttggtcggggggaccgaaggtggacatactaaacgaacta

SEQ ID NO: 784083 - DNA, 510 bp, Homo sapiens
  misc_feature: HIJSMM301DO99G.5.24.C02.1.454.light.4.raw
  modified_base (474)..(474): a, c, t, g, unknown or other
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcgggcgggggaccaagcngaccgtcctaggtcacgcccaaggctcgtccccccg

SEQ ID NO: 784084 - DNA, 505 bp, Homo sapiens
  misc_feature: HIJSMM301CT08H.41.14.B03.1.454.light.4.raw
tctatactatcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagccccaaactcatgatttatgatgtcagtaatcggccctcaggggtttctaatcgcttctctggctccaagtctggcaacacggcctccctgaccatctctgggctccagagtgaagatgaggctgattactactgcgcctcatatgcaggcagcaacaatttcagggtatttggcggagggaccaagctgaccgtcctaggtcagccgaaggctcgccccctcggt

SEQ ID NO: 784085 - DNA, 511 bp, Homo sapiens
  misc_feature: HIJSMM301B6L4X.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctcctgacaatctctgggctccaggctgaggacgaggctgattattactgctgctcatatgcagatggtgacactccccggtggtattcggacgggagggaccaaaggtgaccgtcctaggtccagcccaagggctcgccccccg

SEQ ID NO: 784086 - DNA, 500 bp, Homo sapiens
  misc_feature: HIJSMM301C84WB.11.28.C06.1.454.light.4.raw
cgagagataccacgaccggtgctcgatttagagctcacgtattgggtttgggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcaacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacaggtgtggccttcgtctcgcagttcggcgggagggaccgaaagggtggaagataccaaacgaa

SEQ ID NO: 784087 - DNA, 510 bp, Homo sapiens
  misc_feature: HIJSMM301BJMO2.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcgttcggcggggggaccaagctgaccgtccgtaggtcacgccaaggctcgccccccg

SEQ ID NO: 784088 - DNA, 496 bp, Homo sapiens
  misc_feature: HIJSMM301B4PDH.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcgggcggggggaccaagctcgaccgtccgtaggtcagccc

SEQ ID NO: 784089 - DNA, 490 bp, Homo sapiens
  misc_feature: HIJSMM301AI7JL.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagtatttttctctcgtcatcactggtctacagtctgacgacggcgcaatgtacttctgtcaacactatcgcctcctcccccctacaatttcggtcaggggaccaagttgaacatcaatcgaactgtggctgcacat

SEQ ID NO: 784090 - DNA, 497 bp, Homo sapiens
  misc_feature: HIJSMM301EW5ZB.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaacgcccctaaactcctgatctatcatgaatccagtttgcgaagtggagtcccatcaaggttcagtggcactgggtctgagacagagttcactctcaccatcagcactctacagcctgaagattttgcaacttattattgtcaaacaaagttatgagaccccctgccctactttccggccctgggaaccatagtggatatagaaacgaaactgtggctgcacact

SEQ ID NO: 784091 - DNA, 523 bp, Homo sapiens
  misc_feature: HIJSMM301BPBSA.40.12.B01.1.454.light.4.raw
tctagcgactcacgaccggtgctcgatttagtagtgtagattccgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgatttattactgctactcgtatgcaggcggacaacaattgggtcttcggcggagggaccaagctgccgtcctaggtcagcccaaggctcgccccctggtccactctcgttccctacccc

SEQ ID NO: 784092 - DNA, 504 bp, Homo sapiens
  misc_feature: HIJSMM301A1296.41.45.E01.1.454.light.4.raw
tctatactatcacgaccggtgctcgatttagtgagtcagtaagggaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagcagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtcttatcgggtgttcgggcgggggaccaagctgaccgtcctaggtcagacccaaggctcgcccccgtcggtcactcg

SEQ ID NO: 784093 - DNA, 524 bp, Homo sapiens
  misc_feature: HIJSMM301A2LAZ.7.34.D01.1.454.light.4.raw
cgtgtctctacacgaccggtgctcgatttagatcgtctgtgttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctcctgaccatctctggactccagactgaggacgaggctgattattactgctgctcatatacgaggggacagactattagtttgggtgttcgggcggagggaccaaagctgaccgtcctcgcgtcacgcccaaggctcgccccctcggtcacttccg

SEQ ID NO: 784094 - DNA, 556 bp, Homo sapiens
  misc_feature: HIJSMM301A4583.27.23.C01.1.454.light.4.raw
agcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggaccaggcactgtccccaaactcattctttatgatgtcagtaatcggcccccaggggtttctgatcgcttctatggctccaagtctgcctacaccggcctccctgaccatcctccgggctccagcctgaggacgaggctgattattattgtagttcataatacaaccagtgacacttgggtgttcggcggagggaccgaggctacggaccgtccgttagggtaccacggaccccaaagggcctcggtccccccgtcggtccaccttcctcggttcccccgcccctt

SEQ ID NO: 784095 - DNA, 461 bp, Homo sapiens
  misc_feature: HIJSMM301EHTDK.22.28.C06.1.454.light.4.raw
  modified_base (450)..(450): a, c, t, g, unknown or other
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctcgttcccgccctccncacgcgtatgt

SEQ ID NO: 784096 - DNA, 497 bp, Homo sapiens
  misc_feature: HIJSMM301CYEVH.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacaggaattcactctcaccatcaacagcctgcagcctgatgatttggcaacttactactgccaaccgtatagtacttattcggtcaccttcggccaagggacacggactggagattaaacgaacgtgtggctgcaccatctgtcttcatt

SEQ ID NO: 784097 - DNA, 515 bp, Homo sapiens
  misc_feature: HIJSMM301BHH16.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctcaggctgaggacgaggctgattattactgctgctcatatgcagatggtgaccactccccggtggtattcggcgggagggaccaaagggtcgaccggtcctagggtcaggccccaaggctcgccccccg

SEQ ID NO: 784098 - DNA, 502 bp, Homo sapiens
  misc_feature: HIJSMM301EUDM1.17.29.C07.1.454.light.4.raw
cgtagactagcacgaccggtgctcgatttagagtgctacgaagggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctggaggacgagggtgattattactgcagctcatatagaagtggcagcactctcgtattcggcggtgggaccaagctgaccgtcctaggtcagcccaaggctcgccccccg

SEQ ID NO: 784099 - DNA, 527 bp, Homo sapiens
  misc_feature: HIJSMM301C2AAX.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggaggggaccaggctgaccgtcctaggtcacgcccaaggctgcccccctcggtccactctcgttcccaccctt

SEQ ID NO: 784100 - DNA, 527 bp, Homo sapiens
  misc_feature: HIJSMM301DAU7Z.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccgaaggctcgccccctccggtctactcctcgttccccaccctcccttaccc

SEQ ID NO: 784101 - DNA, 491 bp, Homo sapiens
  misc_feature: HIJSMM301A681S.49.30.C08.1.454.light.4.raw
  modified_base (463)..(463): a, c, t, g, unknown or other
agtcgagagacacgaccggtgctcgatttagtctgacgtcaaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagancaacgaactgtggctgcacatctgtctt

SEQ ID NO: 784102 - DNA, 422 bp, Homo sapiens; identical to SEQ ID NO: 539618
  misc_feature: HIJSMM301BY3CR.41.14.B03.1.454.light.4.raw

SEQ ID NO: 784103 - DNA, 497 bp, Homo sapiens
  misc_feature: HIJSMM301D2SH7.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggcgtgaggatgttggcctttattactgtcatgcaaggtatcttacctcccatacactttggcccggggaccaacgggtggatactcaaagtaactgtggctagcaccta

SEQ ID NO: 784104 - DNA, 491 bp, Homo sapiens
  misc_feature: HIJSMM301AY9IM.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggttggaagtggggtcccatcaaggttcagtggcgccggatctgggacagaattcactctcaccatcagcgggctccagtctgaggactctgcaacttatactgccaacataatgatatttattctcctagccgttcggccgaggggaccgaaggtggaagtcaagcgtaacgtgtggctgccacatctgt

SEQ ID NO: 784105 - DNA, 497 bp, Homo sapiens
  misc_feature: HIJSMM301AFL4A.10.77.G11.1.454.light.4.raw
catagtagtgcacgaccggtgctcgatttagctagtcactcaaggggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctccaggctcctcatctatgatgcatccaacagggccactggcatcccagccaggttcagtggcaggtgggtctgggacagacttcactctcaccatcagcagactagagcctgaagtattttgctagtttattactgtcagcagcgtagcaactggcctcggacgtcgccgaacgggaccgaagtaggacatacaagacgaactgtaggcgtcgcaccactc

SEQ ID NO: 784106 - DNA, 472 bp, Homo sapiens
  misc_feature: HIJSMM301A5GM1.26.78.H01.1.454.light.4.raw
agactatactcacgaccggtgctcgatttagtgtgagtagtttgggtttggggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagatttttgctacttttattactgtcagcagcgtagcaactggcctctctactttcggcggagggaccagggtggagatcagacgaactgtggctgcaccatctgtcttcatcttccccgcctatctgaagtatagttct

SEQ ID NO: 784107 - DNA, 478 bp, Homo sapiens
  misc_feature: HIJSMM301EIGAW.40.23.C01.1.454.light.4.raw
tctagcgactcacgaccggtgctcgatttagtacacgtgattagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtggacatcagctagtgaggttggtttcggcggagggaccaaggctgaccgtcctaacgtcacgccc

SEQ ID NO: 784108 - DNA, 488 bp, Homo sapiens; identical to SEQ ID NO: 535990
  misc_feature: HIJSMM301AJPME.11.28.C06.1.454.light.4.raw

SEQ ID NO: 784109 - DNA, 505 bp, Homo sapiens
  misc_feature: HIJSMM301EDYSX.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcgccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctggaggacgaggctgattattactgcagctcatatacaagcaccagcactctctatgtcttcggaactgggaccaaggtcaccgtcctaggtcagcccaaggcccaacccc

SEQ ID NO: 784110 - DNA, 514 bp, Homo sapiens
  misc_feature: HIJSMM301DHRZA.17.33.C11.1.454.light.4.raw
  modified_base (438)..(438): a, c, t, g, unknown or other
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgacttattactgcctactctacttggtggtgctgtnctattcggcggaggaccaagctgactcgttaatcacgcccaaggctcgccccctcggtcctactctcgttccccta

SEQ ID NO: 784111 - DNA, 500 bp, Homo sapiens
  misc_feature: HIJSMM301EGO6L.53.10.A10.1.454.light.4.raw
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcgggcggggggaccaaacgtgacgtcctagtcgagcccaaggctcgcccctcggtcactttcgttcccgt

SEQ ID NO: 784112 - DNA, 525 bp, Homo sapiens
  misc_feature: HIJSMM301BHRD9.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcacgtccaacggcctcgccccctcggtccactctcgttcccgccctcccttccc

SEQ ID NO: 784113 - DNA, 508 bp, Homo sapiens
  misc_feature: HIJSMM301D9YR1.13.81.H04.1.454.light.4.raw
tcacgtactacacgaccggtgctcgatttagtagtgtagattcgcgggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaaatcatgatttatgatgtcagtaagcggccctcgaggggtccctgatcgcttctctgcctccaagtctggcaacgacggcctccctgaccatctctgggctccaggctgaggatgagtctgatttattactgctgctcatatgcaggcagctaactactgttactagttcggcggaagggaccaagctcgaccgtctaggtcacgccaaggctccgtcccccg

SEQ ID NO: 784114 - DNA, 487 bp, Homo sapiens; identical to SEQ ID NO: 560802
  misc_feature: HIJSMM301AQ25G.15.1.A01.1.454.light.4.raw

SEQ ID NO: 784115 - DNA, 488 bp, Homo sapiens
  misc_feature: HIJSMM301A4Q7O.11.11.A11.1.454.light.4.raw
  modified_base (407)..(407): a, c, t, g, unknown or other
cgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtnaacgctccgctctacgtttcggcggagggaccgcggtggagatcaagaccgaactggtggctggactaccatcctgtcctt

SEQ ID NO: 784116 - DNA, 508 bp, Homo sapiens
  misc_feature: HIJSMM301DCWM6.5.86.H09.1.454.light.4.raw
atcagacacgcacgaccggtgctcgatttagtgctatagacttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtccagcccaaggcctcgccccctcggtcta

SEQ ID NO: 784117 - DNA, 502 bp, Homo sapiens
  misc_feature: HIJSMM301EF1LK.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcgggagggaccaaactgaccgtctaggtcagcccaa

SEQ ID NO: 784118 - DNA, 506 bp, Homo sapiens
  misc_feature: HIJSMM301CGNRN.51.39.D06.1.454.light.4.raw
cgatcgtatacacgaccggtgctcgatttagtgacatctcgcagttctttggggggtgggtccaggaggcagaactctgggtgtctcaccatggcctggatccctctacttctcccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggcctccacctcagggacactggtcacattgaccatcagtggagtccaggcagaagacgaggctgactatttctgtcaatcttcagacgtcagtggtacttatgtcttcggaacgtggaccgaacggtcaccgtcctaggtcacgcccaaggcccaacccccactcgtcact

SEQ ID NO: 784119 - DNA, 500 bp, Homo sapiens
  misc_feature: HIJSMM301BB4KS.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccagggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtcgtgggacagacttcactctcaccatcagcagactggagcctgaggattttgcagtgtattactgtcagcagtatcataggtacaaactaccgttcggccaagggacacgactggagagttaaaggaactgtggctgcaccatctgtcttcatcttccccg

SEQ ID NO: 784120 - DNA, 494 bp, Homo sapiens
  misc_feature: HIJSMM301AIFBN.41.33.C11.1.454.light.4.raw
tctatactatcacgaccggtgctcgatttagagtgagctcgttgggtttgggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgctagtttactactgtctgcagtataaagactggcctagggtctactttcggcccgttgggaccaaagtggatttcaaacgtaacgtagtggctgcacc

SEQ ID NO: 784121 - DNA, 517 bp, Homo sapiens
  misc_feature: HIJSMM301BTZIT.47.85.H08.1.454.light.4.raw
agctcacgtacacgaccggtgctcgatttagtatcactcagtcggcgggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcactactgtcgtttgggtgttcggcggagggaccaagttgaccggtcctaggcagcccaaggctgccccctcggtcactctcgttcccccg

SEQ ID NO: 784122 - DNA, 497 bp, Homo sapiens
  misc_feature: HIJSMM301AYW5K.22.87.H10.1.454.light.4.raw
acatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacagcccccaaactcctcatctatggtaacaacaatcggccctcacggggtccctgaccgattctctggctccaagtctggcatgtcacgcctccctggccatcactgggctccaggctgaggatgaggctgatttatttctgccagtccctatgacaacagcctgggtcgccgtggtattcgggcggagggaccaaggctgaccgtcctac

SEQ ID NO: 784123 - DNA, 475 bp, Homo sapiens; identical to SEQ ID NO: 771634
  misc_feature: HIJSMM301CEK78.7.81.H04.1.454.light.4.raw

SEQ ID NO: 784124 - DNA, 504 bp, Homo sapiens
  misc_feature: HIJSMM301EAE2O.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttcactttcggcggagggaccaaggtggacctcaaacgaactgtggctgcacatctgtcttcatctcccgcc

SEQ ID NO: 784125 - DNA, 502 bp, Homo sapiens
  misc_feature: HIJSMM301AGNSI.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagttacctactttacctacaagtgatcaccttcggaccgaagggacacgactggagtaattaaacgaactgtggctgacaccatctgt

SEQ ID NO: 784126 - DNA, 500 bp, Homo sapiens
  misc_feature: HIJSMM301CP4G7.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccgaggcaggaggacgaggctgactattattgtcaatcaacagacaccattggtacttatgttcttcggaactgcgaccaaggtcaccgtcctgggtcagcccaaggcccaaccccactgtctacc

SEQ ID NO: 784127 - DNA, 526 bp, Homo sapiens
  misc_feature: HIJSMM301AU9YY.27.23.C01.1.454.light.4.raw
  modified_base (227)..(227): a, c, t, g, unknown or other
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcgggtcggagggaccagggctgaccgtcctaggtcagccaaggctgccccctggtccactctcgttcccgccct

SEQ ID NO: 784128 - DNA, 496 bp, Homo sapiens
  misc_feature: HIJSMM301AZGOT.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatcttatttgggttctaatcgggcctccggggtccctgacaggttcagtggcagtggatcaggcacagattttacactagaaaatcagcagagtggaggctgaggatggttggggtttattactgcatgcaagctctacaaacctccttacacttttggccgagggaccaagctggagatacaaacgaactgt

SEQ ID NO: 784129 - DNA, 541 bp, Homo sapiens
  misc_feature: HIJSMM301C9Z9D.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatccagcagggtcgaagccggggatgaggccgactattactgtcaggtgtggaatggtgattatgattatgtcttcggaactgggaccaaggtacgaccgtcctaggttcagaccaacggaccgaaccccaacctcgtcactcctcgttcccgtccctcccctccgtcgttccg

SEQ ID NO: 784130 - DNA, 498 bp, Homo sapiens
  misc_feature: HIJSMM301EC88G.53.11.A11.1.454.light.4.raw
cgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcaggtcagcccaaggctcgccccctacggtcactcctcg

SEQ ID NO: 784131 - DNA, 488 bp, Homo sapiens
  misc_feature: HIJSMM301DDRT1.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtccaccgtcctaggtcagcccaaggcccaacccc

SEQ ID NO: 784132 - DNA, 466 bp, Homo sapiens
  misc_feature: HIJSMM301BEKC5.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgcagtttgcaaagtgggtcccatcaagattcagtggcagtggatctgggacagatttcactctcgccatcagtagtctgcaacctgatgattttgctaacttactactgtacaacagattccactacccaatcacttcgccctggactgagtgcatatgaagagaactgtagc

SEQ ID NO: 784133 - DNA, 508 bp, Homo sapiens
  misc_feature: HIJSMM301BPPLC.2.35.D02.1.454.light.4.raw
  modified_base (393)..(393): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgnggatgaggctgattattactgcagctcatatgcaggcagccagcaatgttacttttcggcgggagggaccaagcctgaccgtcctgggtcagcccaaggctgccccctcggtcta

SEQ ID NO: 784134 - DNA, 490 bp, Homo sapiens
  misc_feature: HIJSMM301A3NU1.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctcgccccctcggtcctacc

SEQ ID NO: 784135 - DNA, 478 bp, Homo sapiens
  misc_feature: HIJSMM301D1IG9.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtctaggcgtgggacatcagcagtgaggtggtttcggcggagggaccaagctgaccgtctaaggtcagaccc

SEQ ID NO: 784136 - DNA, 500 bp, Homo sapiens
  misc_feature: HIJSMM301BVL32.16.1.A01.1.454.light.4.raw
tgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacatttgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgagacgaggctgattattactgccactcatatagaagtggcagcactctcgtattcggcggtgggaccaagctgaccgtcctaggtcagcccaaggctgccccctcggtcactcc

SEQ ID NO: 784137 - DNA, 495 bp, Homo sapiens
  misc_feature: HIJSMM301DI5C2.53.8.A08.1.454.light.4.raw
  modified_base (462)..(462): a, c, t, g, unknown or other
cgcgtatacacacgaccggtgctcgatttagcatactctacagggggtgggtccaggaggcagaactctgggtgtctcaccatggcctggatccctctacttctccccctcctcactctctgcacaggctctgaggcctcccatgagttgatacagccatcctcggtgtcagtgtccccaggacagacggccacgattatttgctctggagatgcattggcaaagcaatttgcttcttggttccagcagaagccaggccaagcccctgtactggtgatttataaaggctctgagaggcccccagggatccctgagcgattctctgggtccgactcagggacaacagccatgttgaccatcagtggagtccaggcagaagacgaggctgactattattgtcagtcagcagacaacactgttgtttctgttgtttttcggcggtagggaccaggctgaccgtcngggtcagccaaggctgcccctggtcactctgtt

SEQ ID NO: 784138 - DNA, 516 bp, Homo sapiens
  misc_feature: HIJSMM301BDEZR.3.79.H02.1.454.light.4.raw
  modified_base (421)..(421): a, c, t, g, unknown or other
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgtctttctggctccaagtctggcaccacggcctccctgaccatcctcggggctccaggctgaggacgaggctgcttattactgacngctcactataacaaggagcaccactctcgtggtatttggtggtagggaccaagctcgaccgtcctaggtcacgcccaaggctcgccccctcggta

SEQ ID NO: 784139 - DNA, 511 bp, Homo sapiens
  misc_feature: HIJSMM301BN6DJ.9.53.E09.1.454.light.4.raw
tgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatattgcagacgtggtcgacactcccgtggtagttcgggcggagggaccaaggtgaccgtcctaggtcagcccaaggctcgcccccg

SEQ ID NO: 784140 - DNA, 503 bp, Homo sapiens
  misc_feature: HIJSMM301BN42H.3.79.H02.1.454.light.4.raw
agacgcactccacgaccggtgctcgatttagtgtcacacgaagggaaagggggggggtctcaggaggcagcgctctcgggacgtctccaccatggcctgggctctgctattcctcaccctcctcactcagggcacagggtcctgggcccagtctgccctgactcagcctccctccgcgtccgggtctcctggacagtcagtcaccatcctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcgccccctcggt

SEQ ID NO: 784141 - DNA, 505 bp, Homo sapiens
  misc_feature: HIJSMM301AMAIV.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgctagtttattactgtcagcagcgtaccaactggccgctctactttcggcgggacgggaccgaagggtggagatacaaacgaactgtggctgcaccatctgtcttcattcc

SEQ ID NO: 784142 - DNA, 377 bp, Homo sapiens; identical to SEQ ID NO: 536071
  misc_feature: HIJSMM301ESVB0.40.9.A09.1.454.light.4.raw

SEQ ID NO: 784143 - DNA, 537 bp, Homo sapiens
  misc_feature: HIJSMM301EUP4H.7.71.G05.1.454.light.4.raw
  modified_base (206)..(206): a, c, t, g, unknown or other
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattggtgttgacacagtctccagccaccctgtctttgtctccaggggaaanagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccggggggccctacgtttccggcccgtgggtaccgaaaacggttagggaagtaattacaaaacggaaccttacggtggctggctaccatcctcgtcttt

SEQ ID NO: 784144 - DNA, 500 bp, Homo sapiens
  misc_feature: HIJSMM301AJ6QM.21.15.B04.1.454.light.4.raw
tcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctccgacaataagaactacttagcttggtaccagcagcaaccaggacaacgtcctaaattgctcatttactgggcatctgtccgggaatccggggtccctgaccgattcgttggcagcgggtctgggacagatttcactctcaccatcagcagcctacaggctgaagatgtggctagttttatttttgtatgcaacattatgccgctccgctcactttcggcggagggaccaaggtggagatcaaacgaactgtggctgcaccat

SEQ ID NO: 784145 - DNA, 468 bp, Homo sapiens
  misc_feature: HIJSMM301AUGGI.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcgcggaggaccgaaggtggagatcaaacgaa

SEQ ID NO: 784146 - DNA, 503 bp, Homo sapiens
  misc_feature: HIJSMM301BPTI2.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgttcaatcagcagacagcaggtggttacttttcggggttttcggcggagggaccaagctgaccgtcctaggtcagcccaaggcctcgccccctcggt

SEQ ID NO: 784147 - DNA, 487 bp, Homo sapiens
  misc_feature: HIJSMM301DUG2H.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacaggacttcactctcaccatcagcagactggagcctgaggattttgcagtgtattactgtcagcagtatcataggtacaaacaccttcggccaagggacacgactggagattaaaggaactgtggctgcaccatctcgtcttc

SEQ ID NO: 784148 - DNA, 520 bp, Homo sapiens
  misc_feature: HIJSMM301AQWQ2.12.71.G05.1.454.light.4.raw
atacgacgtacacgaccggtgctcgatttagtgtcgtcgcaagagagagggggggggtcacaagaggcagcgctctcggaacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagccaaggctgccccctcggtcactctgttcccaccct

SEQ ID NO: 784149 - DNA, 505 bp, Homo sapiens
  misc_feature: HIJSMM301C1VKT.43.62.F07.1.454.light.4.raw
tgtgagtagtcacgaccggtgctcgatttagtagtcgcataaagggaaagggggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagattatgcaacttacttctgtacaacagagtgacagaaacccgtggacgttcggccaagggacgaaggtaggaaagcaaacgaactagtggctgcaccatctgtcttcatcttccccg

SEQ ID NO: 784150 - DNA, 501 bp, Homo sapiens
  misc_feature: HIJSMM301EHKZL.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctccaggctcctcatctttgatgctttcaacagggcccctggcgtcccaggcaggttcagtggcagtgggtctgggacagacttcactctcaccatcagcagcctagagcctgaagattttgctagtttattactgtcagcagcgtgccactttcggcggaggtgccacgtttcggtcggagggaccaaaatagaaggtcaaacgaactgtggactgcaccatctgtc

SEQ ID NO: 784151 - DNA, 478 bp, Homo sapiens
  misc_feature: HIJSMM301EKQLA.43.14.B03.1.454.light.4.raw
tgtgagtagtcacgaccggtgctcgatttagtgtgagtagttccgcggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcggaccaggctatggatgaggctgactattactgtcaggcgtgggacatcagcagtgaggtggttttcggcgggagggaccgaagctagaccgtcctaagtcacgccaac

SEQ ID NO: 784152 - DNA, 521 bp, Homo sapiens
  misc_feature: HIJSMM301EPS7O.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtggttcggcgggagggaccaagctggccgtcctaggtcacgcccaggctcgccccctcggtccactctcgttccccgccctcctcgagtagtacca

SEQ ID NO: 784153 - DNA, 491 bp, Homo sapiens
  misc_feature: HIJSMM301BABQE.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcaggtgggtctgggacagagttcactctcaccatcagcagcctgcagtctgaagtattttgtcggtttattactgtcagcagtataataactggcctccacgtactacttttggccgaggggaccaagctggagatacaaacgaactggtggct

SEQ ID NO: 784154 - DNA, 521 bp, Homo sapiens
  misc_feature: HIJSMM301B5VZI.7.34.D01.1.454.light.4.raw
cgtgtctctacacgaccggtgctcgatttagatcgtctgtgttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggttgttcgggcggagggaccaagctgaccgtcctgcgtcacgcccaaggctcgccccctcggtccacttccg

SEQ ID NO: 784155 - DNA, 491 bp, Homo sapiens
  misc_feature: HIJSMM301BTZA7.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtcttattactgtcagcagtatggtcacgtcccaagtacttttggccgaggggaccaagctggagatacaaacgaactagtggctgcaccat

SEQ ID NO: 784156 - DNA, 512 bp, Homo sapiens
  misc_feature: HIJSMM301BLX6V.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgctagtttattactgtcaacatcgtaccgagtggccgtccgggggccactttccggccctcgggaccaaagtggatatcaaacgaactgtggctgcaccatctgtcttcta

SEQ ID NO: 784157 - DNA, 484 bp, Homo sapiens
  misc_feature: HIJSMM301C9VQA.10.72.G06.1.454.light.4.raw
catagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctctattattactgcagctcatatacacccgagggcactctcgtgatacttcggcggaagggcctggctgaccgtcctacgtc

SEQ ID NO: 784158 - DNA, 499 bp, Homo sapiens
  misc_feature: HIJSMM301D7LSP.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaaacacagcttccttgaccatcactggggctcgaggcggaagatgaggctgactattactgtaactcccgggccagcagtggtaacaattgtgatattcggcgagggaccaaggtgaccgtcctacgtcagcccaaggctgccccctcggtcactctcg

SEQ ID NO: 784159 - DNA, 487 bp, Homo sapiens
  misc_feature: HIJSMM301DQVT6.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaaggacgaggctggactattattgtcaatcagcagacaacagtaatacttatctttatgtcttcggatctggaccaggtcacccgtctaggtcagcccaaggccaaccca

SEQ ID NO: 784160 - DNA, 511 bp, Homo sapiens
  misc_feature: HIJSMM301ENIVZ.40.41.D08.1.454.light.4.raw
tctagcgactcacgaccggtgctcgatttagtcacgcgagaaaggggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactccccatgtggtattcggcggagggaccaagctgaccgtcctaggtcagcccaaggctcgtccccccg

SEQ ID NO: 784161 - DNA, 502 bp, Homo sapiens
  misc_feature: HIJSMM301CIFA8.9.53.E09.1.454.light.4.raw
tgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcgggcggagggaccaaggtcgaccgtccgtaggtccagccccaagg

SEQ ID NO: 784162 - DNA, 506 bp, Homo sapiens
  misc_feature: HIJSMM301BT39R.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgttacttttcggcggagggaccaagctgaccgtcctgggtcagcccaaggctcgccccctcggtcta

SEQ ID NO: 784163 - DNA, 484 bp, Homo sapiens; identical to SEQ ID NO: 535400
  misc_feature: HIJSMM301BWE4Q.46.26.C04.1.454.light.4.raw

SEQ ID NO: 784164 - DNA, 513 bp, Homo sapiens
  misc_feature: HIJSMM301EWYP9.53.49.E05.1.454.light.4.raw
cgcgtatacacacgaccggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcagttcgggcgggacgggaccgaaggcgtgaccgtcctgggtcagcccaaggctcgccccctcggtccactc

SEQ ID NO: 784165 - DNA, 522 bp, Homo sapiens
  misc_feature: HIJSMM301AZS8Y.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctccggtcactctgtcccaccct

SEQ ID NO: 784166 - DNA, 480 bp, Homo sapiens
  misc_feature: HIJSMM301BTTJJ.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttggcggtagggaccagctgaccgtcctaagtccagaccccg

SEQ ID NO: 784167 - DNA, 474 bp, Homo sapiens
  misc_feature: HIJSMM301CG34N.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcgggagggaccaagatgcagatcaaacgaa

SEQ ID NO: 784168 - DNA, 490 bp, Homo sapiens
  misc_feature: HIJSMM301AMGTI.40.40.D07.1.454.light.4.raw
tctagcgactcacgaccggtgctcgatttagtgatagagcgtaacaacagaggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacgttgggtgttcggcagagggaccaagctgaccgtcctaggtcagccc

SEQ ID NO: 784169 - DNA, 508 bp, Homo sapiens
  misc_feature: HIJSMM301E0KSZ.43.35.D02.1.454.light.4.raw
tgtgagtagtcacgaccggtgctcgatttagcacacgatagttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctctatatgcaggtacgttacacttatgttcttcggtaattgggacgacggtcaccgtctaggtcagacccaaggcccaacccccac

SEQ ID NO: 784170 - DNA, 488 bp, Homo sapiens
  misc_feature: HIJSMM301BVXQZ.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgagattttgcggtttattactgtcagcagtataaataactggcctccacggtacactttggccagggaccaagctggagatcaaacgaactgtaggctgcac

SEQ ID NO: 784171 - DNA, 520 bp, Homo sapiens
  misc_feature: HIJSMM301D2PTW.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaacgtggaccaaggtcaccgtcctaggtcagcccaaggaccaaccccactcgtcactctcgttcccgccctcctccgt

SEQ ID NO: 784172 - DNA, 499 bp, Homo sapiens
  misc_feature: HIJSMM301CXUQJ.43.28.C06.1.454.light.4.raw
tgtgagtagtcacgaccggtgctcgatttagagctcacgtattgggtttgggggatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctgggggtcccagacaggttcagcggcagtgggtcagacactgacttcacactgagaatcagcagggtggaggctgaggatggttggaatttattactgcatgcaatcttcacactcggcctccgtactacttttggccgtagggggaccaaggcctggagatacaaacgaactg

SEQ ID NO: 784173 - DNA, 489 bp, Homo sapiens
  misc_feature: HIJSMM301BSDMD.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagcctgctcatttactgggcatctatccgggaatccggggtccctgaccgattcagtggcagcgggtctgggacagatttcactctcaccatcagcagcctgcaggctgaagatgtggcagtttattactgtcagcaatattatagttactcctccgacggcttcactttcggcggagggaccaaggtggagatacaacgaa

SEQ ID NO: 784174 - DNA, 505 bp, Homo sapiens
  misc_feature: HIJSMM301EYK01.51.23.C01.1.454.light.4.raw
cgatcgtatacacgaccggtgctcgatttagtacacgtgattagggattgggggggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggccttggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagagtcaacgaactgtggctgcaccatcctgtcttcatcttcccgccat

SEQ ID NO: 784175 - DNA, 498 bp, Homo sapiens
  misc_feature: HIJSMM301AUA71.19.10.A10.1.454.light.4.raw
tactctcgtgcacgaccggtgctcgatttagcgtcgatctcagggggagctgctcagttaggacccagagggagccatggaaaccccagcgcagcttctcttcctcctgctactctggctcccagatagcaccggagaaattttcttgacgcaatctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatcccccgacaggttcagtggcagtgtgtctgggacagacttcactctcaccatcagcagactggagcctgaagattttgcagtgtattactgtcaacgatatgatgagtcacctcgtggtggacatttggccaggggaccaaggttagaagtacaacgaactgtggctgcacatctgtcttcattcc

SEQ ID NO: 784176 - DNA, 496 bp, Homo sapiens
  misc_feature: HIJSMM301D3J9O.14.55.E11.1.454.light.4.raw
  modified_base (364)..(364): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtnagtagtctgcaacctgaagattttgactaacttactactgtcaacagattacacgtacccccctcacctttcggcggagggaccgaaggcggagatcagacgaactgtggctgccaccatctgtcttcactt

SEQ ID NO: 784177 - DNA, 505 bp, Homo sapiens
  misc_feature: HIJSMM301CZJ2J.41.18.B07.1.454.light.4.raw
  modified_base (484)..(484): a, c, t, g, unknown or other
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtcgatgtataaagacagtgagaggccctcagggatccctgagcgattctctggcgccagctcaggaacagtagtcacgttgaccatcagtggagtccaggcagaagacgaggctgactattattgtcaaagcagtagacagcagtggtccttatcgggtgtttcggcggggggtaccaaagctgaccgtcctacggtcagcccaaggccngcccctccggtcgactctgtt

SEQ ID NO: 784178 - DNA, 494 bp, Homo sapiens
  misc_feature: HIJSMM301CAQNA.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcactctcaccatcagcagactggacgcctgaagattttgcagtctattactgtcagcagtatggtcacgtacccaagtaacttttcggaccgaggggaccaagctggagatacaaacgaactgtggctgcaccat

SEQ ID NO: 784179 - DNA, 478 bp, Homo sapiens
  misc_feature: HIJSMM301ELXCH.40.23.C01.1.454.light.4.raw
tctagcgactcacgaccggtgctcgatttagtacacgtgattagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtggaggtggttttcgggtcggagggaccaagctgacccgtcctaacgtca

SEQ ID NO: 784180 - DNA, 480 bp, Homo sapiens
  misc_feature: HIJSMM301BJW2M.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactcctgaccatcagcgggaccagctatggatgaggctgactattactgtcaggcgtgggacatcagcagtgaaggtggtttcggcggacgggacaaggctgaccgtcctaaggtcagcccaac

SEQ ID NO: 784181 - DNA, 497 bp, Homo sapiens; identical to SEQ ID NO: 570888
  misc_feature: HIJSMM301BMNR4.13.67.G01.1.454.light.4.raw

SEQ ID NO: 784182 - DNA, 524 bp, Homo sapiens
  misc_feature: HIJSMM301AYJDG.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcgggagggaccaagctggaccgtcttaagtcgacgacccaaggcctccggccccctcggtccacctcttcgttcccccta

SEQ ID NO: 784183 - DNA, 508 bp, Homo sapiens
  misc_feature: HIJSMM301EIQ5I.40.12.B01.1.454.light.4.raw
tctagcgactcacgaccggtgctcgatttagtagtgtagattccgcgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtacttcggcggagggccaagctgaccgtcctaggtcagcccaaggctgccccctcggtcact

SEQ ID NO: 784184 - DNA, 507 bp, Homo sapiens
  misc_feature: HIJSMM301CCSNV.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaactagtttttaccctcacaaactcatatcacagaatctgaggatgctgcattttacttcggtctacaacatgtataatttccctccgtggtacgttcggccaagggaccaaggagacaaatacaaacgaactagtggctgcaccatctgtcttctatccttcccgcctat

SEQ ID NO: 784185 - DNA, 485 bp, Homo sapiens; identical to SEQ ID NO: 607513
  misc_feature: HIJSMM301C6M61.46.35.D02.1.454.light.4.raw

SEQ ID NO: 784186 - DNA, 492 bp, Homo sapiens
  misc_feature: HIJSMM301ANUHR.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgctagtttattcctgtcagcagtacaatagactggccgtactacttttggccaggggaccaagctggagatcaaacgactagtggctgcaccatcg

SEQ ID NO: 784187 - DNA, 517 bp, Homo sapiens
  misc_feature: HIJSMM301ALKHY.48.56.F01.1.454.light.4.raw
  modified_base (478)..(478): a, c, t, g, unknown or other
agtatacatacacgaccggtgctcgatttagcagacgtctgaacacacaaaggggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcgggagggaccacactgaccgttancggtcacgcccaaggctcgccccctcggtcactcttccg

SEQ ID NO: 784188 - DNA, 490 bp, Homo sapiens
  misc_feature: HIJSMM301AQP0H.48.27.C05.1.454.light.4.raw
  modified_base (422)..(422): a, c, t, g, unknown or other
agtatacatacacgaccggtgctcgatttagacgcgatcgaagggtttgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctactggatgaggctgactattactgtcaggcgtgggtacatnagcaaggtgaggtggttttcgggcgggtagggaccaaggctgaccgtcctaagtcagcccaaggctcc

SEQ ID NO: 784189 - DNA, 487 bp, Homo sapiens
  misc_feature: HIJSMM301BUW0Z.48.73.G07.1.454.light.4.raw
agtatacatacacgaccggtgctcgatttagctctacgctcagggcacgaccggtgctcgatttagactcatctacaggggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaacgccctaagctcctgatctatgctgcatccactttgcaaaatggggtcccatcgagattcagcggcagtggatctggcacagagttcactctcaccatcagcaccctgcagcctagaagattttgcgtacttatttctgtctacaagtattctaacttaccctcggtacgttcggccgtagggaaccg

SEQ ID NO: 784190 - DNA, 480 bp, Homo sapiens
  misc_feature: HIJSMM301DW9FS.11.11.A11.1.454.light.4.raw
cgagagataccacgaccggtgctcgatttagctacgactgcagggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggctagtttattactgtcagcagtatgtgaagctcgctcactttcggcggagggaccgcgggtggagatcaggacgaactgtggctgcaccatctgtctt

SEQ ID NO: 784191 - DNA, 493 bp, Homo sapiens; identical to SEQ ID NO: 535770
  misc_feature: HIJSMM301AQTHM.51.71.G05.1.454.light.4.raw

SEQ ID NO: 784192 - DNA, 488 bp, Homo sapiens
  misc_feature: HIJSMM301C8ZYK.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtccaagtaactttggccaggggaccaagctggagatacaaacgaactgtggctagcaccat

SEQ ID NO: 784193 - DNA, 447 bp, Homo sapiens; identical to SEQ ID NO: 669150
  misc_feature: HIJSMM301CG6F9.18.9.A09.1.454.light.4.raw

SEQ ID NO: 784194 - DNA, 504 bp, Homo sapiens
  misc_feature: HIJSMM301EF8KD.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacaccttgggtgttcggcggagggaccaagctgaccgtcctaggtcagcccaaggcctgccccctcggtccactctcgttcccgcccctcctccg

SEQ ID NO: 784195 - DNA, 499 bp, Homo sapiens
  misc_feature: HIJSMM301A3EDW.51.71.G05.1.454.light.4.raw
  modified_base (491)..(491): a, c, t, g, unknown or other
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgacgaccaaggtcaccgtcctagggtcagcccaacggccaaccccnctcgtcta

SEQ ID NO: 784196 - DNA, 486 bp, Homo sapiens
  misc_feature: HIJSMM301DVMQ4.43.33.C11.1.454.light.4.raw
  modified_base (360)..(360): a, c, t, g, unknown or other
  modified_base (457)..(457): a, c, t, g, unknown or other
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggcccacctcggttcagtggcaacggctctgagacagatttttcnctcgtcatcactggtctacagtctgacgacggcgcaatgtacttctgtcaacactatgcctctcccccctacatttcggcagggaccaagttgaacntacaatcaactgtgctgcacatctgtctt

SEQ ID NO: 784197 - DNA, 484 bp, Homo sapiens
  misc_feature: HIJSMM301EALE5.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagtcggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 784198 - DNA, 491 bp, Homo sapiens
  misc_feature: HIJSMM301COAKR.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtgggtcccatcaaggttcagcggcagtgaaactgggacagaattcattctcaccatcagcagcctgcagccttgatgattttgcaacttattactgccaacagtatagagttatcgtggacgttcgcacggaccgaggtaggaagtacaaacgaactagtggctgcgaccatctgtcttc

SEQ ID NO: 784199 - DNA, 496 bp, Homo sapiens
  misc_feature: HIJSMM301BYGI7.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggcccactggtatcccagaccggttcagtggcagtgggtctgggacagacttcactctcaccatcagcagtctgcagtctgaagattttgctagtttattactgtcagcagtataataactggcctccgtacatgtacacttttggccacggggaccaacctggagatcagacgaa

SEQ ID NO: 784200 - DNA, 528 bp, Homo sapiens
  misc_feature: HIJSMM301BYSBZ.7.86.H09.1.454.light.4.raw
cgtgtctctacacgaccggtgctcgatttagtgctatagacttgggtttgggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggcctccccgactcctcttctttggtggagcctacagggccactggccaccccagacaggatcagtggcagcgggtctgggacagacttcatttctcaccatcaacagaactgcagcctgaagatattgctagtttactactgtcagcagtatgttacgtccccgtggacgttcggccgaagggaccaaggtggcgaatcaaccgaactgtggctgcaccatctgtcttcactccttccccg

SEQ ID NO: 784201 - DNA, 511 bp, Homo sapiens
  misc_feature: HIJSMM301AGN1H.40.12.B01.1.454.light.4.raw
tctagcgactcacgaccggtgctcgatttagtagtgtagattccgcgggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtctaggtcagcccaaggctcgccccctcggtcactctcgtt

SEQ ID NO: 784202 - DNA, 506 bp, Homo sapiens
  misc_feature: HIJSMM301APWW2.43.14.B03.1.454.light.4.raw
tgtgagtagtcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcagcagcacttatgtcttcggaactgggaccaggtcaccgacctaggtcagcccaaggcccaaccccactgtctacc

SEQ ID NO: 784203 - DNA, 486 bp, Homo sapiens
  misc_feature: HIJSMM301A5PC9.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaaatacttatctttattgtcttcggatctgggaccagggtcaccgtctaggtcagacccagcccaa

SEQ ID NO: 784204 - DNA, 490 bp, Homo sapiens
  misc_feature: HIJSMM301ADNK0.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggcctaagggacacgactggagaattaaacgaactagtggctgcacctac

SEQ ID NO: 784205 - DNA, 515 bp, Homo sapiens
  misc_feature: HIJSMM301D7XVA.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagccccaaactcatcatttatgatgccactaagcggccctcaggggtttctaatcgcttctctggctccaagtctggcaacacggcctccctgacaatctcttgggctccaggctgaggacgaggctgattactactgctgctcatatgcaggtcgtatctcttatgttcttcggaactgggaaccaaggtaccaccgtcctaggtcaggccccaaggccaacccccactcgttca

SEQ ID NO: 784206 - DNA, 506 bp, Homo sapiens
  misc_feature: HIJSMM301E4DPA.48.37.D04.1.454.light.4.raw
  modified_base (480)..(480): a, c, t, g, unknown or other
  modified_base (489)..(489): a, c, t, g, unknown or other
  modified_base (492)..(492): a, c, t, g, unknown or other
agtatacatacacgaccggtgctcgatttagtagcatactgttgggtttggggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagccctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagccctagagccccgaagtattttgcggttttattactgtcagcagcgtgccaactgcctctcacgttcgggcggagggaccaaggtggacatcaaacgactgnggctgcacntcngtctcatctccccg

SEQ ID NO: 784207 - DNA, 478 bp, Homo sapiens
  misc_feature: HIJSMM301AQ974.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccatttacaaagtggggtcccatcgcggttcagcggcagtggatatgggacatatttcactctcgccatcagcagcctgcagcctgaagattttgctaacttactattgtcaacaggctaacagtttcccgctcaccttcgggcgggggaccgaaggtggagatacaacgaactgtgctgcac

SEQ ID NO: 784208 - DNA, 506 bp, Homo sapiens
  misc_feature: HIJSMM301CVYYC.41.12.B01.1.454.light.4.raw
tctatactatcacgaccggtgctcgatttagtagtgtagattccgcgggcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgccgtccaccagggcaactggtatcccagcccaggttcagtggcgttgggtctgggacagagttcactctcaccatcaccagcctgcagtctgaagattttgcagtttattactgtcaccaatactaataactgtactacttttggcctaggggaccaagctacgagatacaaacgaa

SEQ ID NO: 784209 - DNA, 508 bp, Homo sapiens
  misc_feature: HIJSMM301E2C4I.11.57.F02.1.454.light.4.raw
  modified_base (475)..(475): a, c, t, g, unknown or other
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaggtggaagtcaagcgaacngtggctgcaccatctgtcttcatccttcccgca

SEQ ID NO: 784210 - DNA, 511 bp, Homo sapiens; identical to SEQ ID NO: 550438
  misc_feature: HIJSMM301AKU9Z.17.33.C11.1.454.light.4.raw

SEQ ID NO: 784211 - DNA, 524 bp, Homo sapiens
  misc_feature: HIJSMM301BOPH7.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacgttgggtgttcgggcggagggaccaggctgaccgtcctaggtcagcccaaggctcgccccctcggtcactctgttcccaccct

SEQ ID NO: 784212 - DNA, 516 bp, Homo sapiens
  misc_feature: HIJSMM301B05U2.53.20.B09.1.454.light.4.raw
cgcgtatacacacgaccggtgctcgatttagtgtagtgtgaaggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccaccctgaccatcagcagggtcgaagccggggacgaggccgactattactgtcaggtgtgggattttaatagtgatcattgggtgttcggcggaggaccaagctgaccgtcctaggtcagcccaaggctgccccctcggtcactctcgttcccgccctcctctcgta

SEQ ID NO: 784213 - DNA, 513 bp, Homo sapiens
  misc_feature: HIJSMM301EQV2N.47.83.H06.1.454.light.4.raw
  modified_base (105)..(105): a, c, t, g, unknown or other
agctcacgtacacgaccggtgctcgatttagatcacgtgcgtcgcggggggggtctcaggaggcagcgctctcaggacatctccaccatggcctgggctctgctnctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcagggtttctcatcgcttctctggctccaatctggcaacacggcctccctgaccatctctgggctcgagtctgaggacgaggctgattacttctgttgctcttgggcactactgtcggtttgggtgttcggcgggagggaccaagttcgaccggtcctaggtcacgcccaaggctgccccctcggtccactctcgtt

SEQ ID NO: 784214 - DNA, 457 bp, Homo sapiens
  misc_feature: HIJSMM301EWHGT.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctcgccccctcggtcactctgttccccaccctccctccacgagagta

SEQ ID NO: 784215 - DNA, 498 bp, Homo sapiens
  misc_feature: HIJSMM301AN8J3.49.68.G02.1.454.light.4.raw
  modified_base (383)..(383): a, c, t, g, unknown or other
agtcgagagacacgaccggtgctcgatttagtcgatagtgaagggaaagggggaggaactgctcagttaggacccagagggaaccatggaagcccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagancctgaagattctgcagtttattactgtcagcagcgtagcaactggcctctcactttcggcggagggaccgaaggtggagatcaaacgaactagtggcgtgcaccatcttgtcttt

SEQ ID NO: 784216 - DNA, 514 bp, Homo sapiens
  misc_feature: HIJSMM301EZQW9.15.34.D01.1.454.light.4.raw
  modified_base (389)..(389): a, c, t, g, unknown or other
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagacccccaggccagcctccacgcacgctcatctacagtacaaacactcgctcttccggggtccctgatcgcttctctggctccatccttgggaacaaagctgccctcaccatcacgggggcccaggcagacgatgaatgtgattancactgctcctttatgtgggcgtggcatttgggtgttcggcggagggaccaaactgaccgtcctaggtcagcccaaggctgccccctggtccactctcgttccccaccctcctcgctaacgtacga

SEQ ID NO: 784217 - DNA, 506 bp, Homo sapiens
  misc_feature: HIJSMM301CGQN7.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcacgcccaaggctgccccctcggtctacc

SEQ ID NO: 784218 - DNA, 494 bp, Homo sapiens
  misc_feature: HIJSMM301AZZAU.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatggaggctgactattattgtcaggcgtgggacagcagcactcgcccgttatgtcttcggaactgggaccaaggtccacgtcttgagtcagcccaggcccaacccc

SEQ ID NO: 784219 - DNA, 507 bp, Homo sapiens
  misc_feature: HIJSMM301BMOA1.9.21.B10.1.454.light.4.raw
tgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagtatattcggcggagggaccaggctgaccgtctgagtcagcccaaggctcgtccccccg

SEQ ID NO: 784220 - DNA, 505 bp, Homo sapiens
  misc_feature: HIJSMM301BJICN.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaaggccggggatgaggccgactattactgtcaggtgtgggatagtagtggtgatcatccatacgtcttcggaactgggaccaaggtctccgtcctacgtcagcccaggccaacctccactgtcact

SEQ ID NO: 784221 - DNA, 518 bp, Homo sapiens
  misc_feature: HIJSMM301A7I6R.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtctaagtcagcccaaggctgccccctcggtcactctgttcccacct

SEQ ID NO: 784222 - DNA, 504 bp, Homo sapiens
  misc_feature: HIJSMM301AQKKN.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcggggggaccaagctgaccgtcctaggtcagcccaaggcctgccccctcggtccactctccg

SEQ ID NO: 784223 - DNA, 498 bp, Homo sapiens
  misc_feature: HIJSMM301CDF5J.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcgggagggaccgaggggtggaggatacaaacgaactgtggctggcaccactctgtcttc

SEQ ID NO: 784224 - DNA, 505 bp, Homo sapiens
  misc_feature: HIJSMM301A0NOK.5.24.C02.1.454.light.4.raw
  modified_base (456)..(456): a, c, t, g, unknown or other
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatggaggctgattattactgcagctcatatgcaggcagcagcacgtccccatagngtatcgttcgggcggggggaccgaagcgtcgaccggtcctacggtcacg

SEQ ID NO: 784225 - DNA, 493 bp, Homo sapiens
  misc_feature: HIJSMM301E1W5U.10.72.G06.1.454.light.4.raw
catagtagtgcacgaccggtgctcgatttagctacgactgcaagggaaaggggggggtctcaggaggcagcgctctcgggacgtctccaccatgacctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctctgatattcggcggagggacctggctgaccgtcctacgtcacgcccaac

SEQ ID NO: 784226 - DNA, 495 bp, Homo sapiens
  misc_feature: HIJSMM301ERUKH.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcaccttcggccaagggacacgactggaagattaaacgaactgtggctgcaccatctgtcttcatt

SEQ ID NO: 784227 - DNA, 482 bp, Homo sapiens
  misc_feature: HIJSMM301C2P91.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcaggggcgttgcaaatgctttggcctggtttcagcagacaccaggggaaggcccctaagcgcctgatctatggtgcatacactttgcaaagtggggtccatcaaggttcagcgcagtaggtctgggacagagttcactctcactatcagcggcctgcagcctgaagattctgcaacttattactgtctccagtatgatgccttacctcggactttcggcgaacggacacggtagaagtcaaacgaactagtggctgcacc

SEQ ID NO: 784228 - DNA, 480 bp, Homo sapiens
  misc_feature: HIJSMM301B94KQ.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggacagtattttaatttcaccatcagcagcctaccaacgtgatgatgttgcaacatactattgtcagcaatatgattttgctcctccgagtcgcctacgttttgggcggggggaccaagggtggacatcaaacgaact

SEQ ID NO: 784229 - DNA, 528 bp, Homo sapiens
  misc_feature: HIJSMM301EZ2QK.7.86.H09.1.454.light.4.raw
cgtgtctctacacgaccggtgctcgatttagtgctatagacttgggtttgggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaaacctggccaggctccccgactcctcttctttggtggagcctacagggccactggccaccccagacaggatcagtggcagcgggtctgggacagactttcattctcaccatcaacagactgcagcctgaagatattgcagtttactaactgtcagcagtatgttacgtccccgtggacgttcggccaagggaccaaggtggcaatacaaccgactagtggctggccaccatctgtcttctattcttccccg

SEQ ID NO: 784230 - DNA, 515 bp, Homo sapiens
  misc_feature: HIJSMM301BTSKB.13.33.C11.1.454.light.4.raw
  modified_base (437)..(437): a, c, t, g, unknown or other
tcacgtactacacgaccggtgctcgatttagagtgagctcgttgggtttggggggggtctcaggaggcagcgctctcggggcgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccagtgacattggtgattataattatgtctcctggtaccaacagtgcccaggcaaagcccccaaactcatcatttatgaagtcatttatcggccctcagggatttctaatcgcttctctggctccaagtctggcaacacggcctccctgacaatctctggactccaggccgaggacgaggctgatttttactgttgttcatatgcaggaaggngtgattatgttcttggaagtgggaccaaggtcaccgtcttggtcagcccaaggccaacccccactcgtcactctcgtt

SEQ ID NO: 784231 - DNA, 499 bp, Homo sapiens
  misc_feature: HIJSMM301E222D.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagttttattattgtcagcaaatattatattcctcctcagacgttcggccaagggaccaaggtggaaatcaaacgaactagtggctgcacc

SEQ ID NO: 784232 - DNA, 533 bp, Homo sapiens
  misc_feature: HIJSMM301A3O4O.41.87.H10.1.454.light.4.raw
tctatactatcacgaccggtgctcgatttagcagtactgcgttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacaccaggcaaagtccccaaactcataatttatgaggtctctaagcggccctcgagggtccctggtcgcttctctggctccaagtttggcaacacggcctccctgaccgtctctgggctccagagtgaagatgaggctgattactactgcgcctcatatgcaggcaggcaaacatttcagggttatttgggcggagggaccgaagctgaccgtcctggggtcaggcccaacggctcggccccctcggtccacttctcgttcccta

SEQ ID NO: 784233 - DNA, 533 bp, Homo sapiens
  misc_feature: HIJSMM301BZT5T.7.34.D01.1.454.light.4.raw
cgtgtctctacacgaccggtgctcgatttagatcgtctgtgttgggtttgggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtcttctaatcggccctccggcgtttctattcgcttctctggctccaagtctggcaacacggcctccctgaccatctcttggactccagactgaggacgaggctgattattactgctgctcatatacaggggacaaggcattatttgggtgttcgggcggagggaaccaaggctcggaccgtcctcggcgtcaagccccgaaggcctcggccccctcggtccacttcc

SEQ ID NO: 784234 - DNA, 477 bp, Homo sapiens
  misc_feature: HIJSMM301A1JEO.5.34.D01.1.454.light.4.raw
atcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagtattttgctaacttactattgtacaacaggctaacagtttccctccgaccttcggaccaagggacacgactgagataaacgaactgtgc

SEQ ID NO: 784235 - DNA, 481 bp, Homo sapiens
  misc_feature: HIJSMM301EA5H7.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcaggtgggtctgggacagagttcactcctcaccatcagcagcctgcagtctgaggtattttgctagtttattactgtcagcattacaataactggcctcggctcactttcggcggagggaccgaaggtggagatacaaacgaactgt

SEQ ID NO: 784236 - DNA, 507 bp, Homo sapiens; identical to SEQ ID NO: 626672
  misc_feature: HIJSMM301BM33J.5.24.C02.1.454.light.4.raw

SEQ ID NO: 784237 - DNA, 484 bp, Homo sapiens
  misc_feature: HIJSMM301E1LAD.5.70.G04.1.454.light.4.raw
atcagacacgcacgaccggtgctcgatttagtgtagtgtgaagggaaagggggcaggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgctaacttactttgtcaacaggctcagatttcccgctcactttcggcggagggaccaaggtcggagatacaaacgaactagtggctcg

SEQ ID NO: 784238 - DNA, 511 bp, Homo sapiens
  misc_feature: HIJSMM301C9PRC.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggtcctccctgaccgtctctgggctccaagctgaggatgaggctgattattactgcagctcatatgcaggcagcagcaatgttacgttttcggcggagggaccaagctgaccgtccgtgggtcacggcccaaggctcgccccctcggtcta

SEQ ID NO: 784239 - DNA, 504 bp, Homo sapiens
  misc_feature: HIJSMM301DV7RA.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctcctccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttataccgttggacgttcggtccgaagggaccgacgggtaggaagtacaaacgaaactgtggctgcaccatctgtcttctatt

SEQ ID NO: 784240 - DNA, 383 bp, Homo sapiens; identical to SEQ ID NO: 684786
  misc_feature: HIJSMM301BU67M.41.33.C11.1.454.light.4.raw

SEQ ID NO: 784241 - DNA, 502 bp, Homo sapiens
  misc_feature: HIJSMM301B4T1M.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctggggacagagttcactctcaccatcagcagcctgcagtctgaagtattttgcggtttattactgtcagcagtataataactggcctccacggtactacttttggccgaggggaccagactggagatcaaacgaactgtggctgccaccatctgtt

SEQ ID NO: 784242 - DNA, 520 bp, Homo sapiens
  misc_feature: HIJSMM301D82DW.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagcttttttgctgactcagccccactctgtgtcggggtctccggggaagacggtaaccatctcctgcaccggcagcagtggcaacattgccacgaagtatgtgcagtggtaccagcagcgcccgggcagtcgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataattaacgtctttgtttttttcggcggtcgggaccaaggctgaccgtcctaggtcagacccaaggcctcgcccccgtccggtcta

SEQ ID NO: 784243 - DNA, 495 bp, Homo sapiens
  misc_feature: HIJSMM301AXMWV.51.80.H03.1.454.light.4.raw
cgatcgtatacacgaccggtgctcgatttagctgtgcgtcgaagggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctgcccccctcggtcacttccg

SEQ ID NO: 784244 - DNA, 441 bp, Homo sapiens
  misc_feature: HIJSMM301CR3YT.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggtagggaccaaactgaccgtcctaggtcagcccaaggctgccccctggtcactctgttcccaccctcctcatagtataga

SEQ ID NO: 784245 - DNA, 493 bp, Homo sapiens
  misc_feature: HIJSMM301BVEJS.46.26.C04.1.454.light.4.raw
  modified_base (446)..(446): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctggaggagtgttgggctctattattgcatgcaagctctacaagtcccnctccactttcggtcggagggaccgaaggtggagacgtcaaaacgact

SEQ ID NO: 784246 - DNA, 514 bp, Homo sapiens
  misc_feature: HIJSMM301D0M79.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctcctgaccgtctctgggctccaggctgaggatgaggctgattattactgcagctcatatgcaggcagcagcagtccccatgtgatcgttcggccggggggaccaaggctcgaccgtccgtaggtcagcccaaggcgtcgtccccccg

SEQ ID NO: 784247 - DNA, 518 bp, Homo sapiens
  misc_feature: HIJSMM301D6OOR.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtccactctcgttcccgccctctccc

SEQ ID NO: 784248 - DNA, 493 bp, Homo sapiens
  misc_feature: HIJSMM301EYWAA.47.48.E04.1.454.light.4.raw
agctcacgtacacgaccggtgctcgatttagagagcgtcacagagagaagggggaatcagtccccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgccttaccctcggtactttcggccgaaggaccgaacggtaggaaatacaaacgaactagtggctcgcaccta

SEQ ID NO: 784249 - DNA, 383 bp, Homo sapiens; identical to SEQ ID NO: 447524
  misc_feature: HIJSMM301DNHK6.41.26.C04.1.454.light.4.raw

SEQ ID NO: 784250 - DNA, 509 bp, Homo sapiens
  misc_feature: HIJSMM301ANK19.3.33.C11.1.454.light.4.raw
agacgcactccacgaccggtgctcgatttagagtgagctcgttggggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcgaggggtccctgatcgcttctctgcctccaagtctggcaacacggcctccctgaccgtctctgggctccagcctgaggatggaggctgattattactgcagctcatatgcaggcatacaactacttgttttcggcgggagggaccaagctcgaccgtcctaggtcagcccaaggctcgtccccccg

SEQ ID NO: 784251 - DNA, 550 bp, Homo sapiens
  misc_feature: HIJSMM301E290Y.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatcccctgagcgattctctggctccaagtctgggaacacggccaccctgaccatcagcagggtcgaagccggggatgaggccgactattactgtcaggtgtggaagtggtgattatgattatgtcttcggtaacgtggaaccgacggtacgaacccgtccgtacggtctacgacccgaacgaccgaacccccaccgacgtccactactcgttcccaccccgtccctcccgttc

SEQ ID NO: 784252 - DNA, 445 bp, Homo sapiens
  misc_feature: HIJSMM301D1FX9.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtattggctgttcggcggcgggaccaagttgaccgtcctacgtcagcccaaggctcgccccctcggtcactctgttctcacccctcctcgacacgcgag

SEQ ID NO: 784253 - DNA, 486 bp, Homo sapiens
  misc_feature: HIJSMM301B1B3W.47.36.D03.1.454.light.4.raw
  modified_base (416)..(416): a, c, t, g, unknown or other
  modified_base (461)..(461): a, c, t, g, unknown or other
  modified_base (469)..(469): a, c, t, g, unknown or other
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtcggggtccatcaaggttcagcggcagtggatctgggacagatttcactctcactatcagcagcctgcagcctagagtatttggacttattattgtcaanagggtacagtttcccgctcaccttcggcggaggaccaaggtgganatgaaaanacgtagtgctgcaccat

SEQ ID NO: 784254 - DNA, 530 bp, Homo sapiens
  misc_feature: HIJSMM301AP992.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctcgatcgcttctctggctccatccttgggaacaaagctgccctcaccatcacggggcccaggcagacgatgaatgtagattatcactgcgtcctttatgtggggcgtggctatttgggttgttcggcggagggaccgaaactgaaccgtcctacggtcagacccaaggacctcgcccccgtccggtccactcttccg

SEQ ID NO: 784255 - DNA, 511 bp, Homo sapiens
  misc_feature: HIJSMM301DPTN6.13.46.E02.1.454.light.4.raw
  modified_base (429)..(429): a, c, t, g, unknown or other
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacaggggactccggggtcccagacagattcagcgcagtgggtcaggcactgatttcacactgaaaatcagcagggtggaggctgaggatgttattgggctctattattgcatgnaaagcgaaacacaacctcggaccgtacgtacttttaggccgaacggggaaccaagcgtaggagatacaacgttacgaacgtc

SEQ ID NO: 784256 - DNA, 514 bp, Homo sapiens
  misc_feature: HIJSMM301A9H6G.41.53.E09.1.454.light.4.raw
tctatactatcacgaccggtgctcgatttagagagagtgtgttgggtttgggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctggagggacgaggctgtattattactgcagctcatatacaagcaagcagcactctcgtggtagttcgggcggagggaccaagcgtcgaccgtccgtaggtccacgcccgaacggtcccg

SEQ ID NO: 784257 - DNA, 496 bp, Homo sapiens
  misc_feature: HIJSMM301DKISM.14.53.E09.1.454.light.4.raw
cgtctagtaccacgaccggtgctcgatttagagagagtgtgttgggtttgggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaaccttgaccatcagtgcagtccaggcagaagacgaggctgactattattgtcaatcagcagtcagcactaattcttatcgggtgttcggcgggaggaccaagctgaccgtcctaggtcagcccaaggctcgccccctcggt

SEQ ID NO: 784258 - DNA, 520 bp, Homo sapiens
  misc_feature: HIJSMM301B7H1N.43.23.C01.1.454.light.4.raw
tgtgagtagtcacgaccggtgctcgatttagtacacgtgattagggattggggtggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtccgtgggtcagcccaaggcctcgccccctcggtccactctcgttcccgccctccta

SEQ ID NO: 784259 - DNA, 506 bp, Homo sapiens
  misc_feature: HIJSMM301AM5K5.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattacttgcaggtcatatacaatcagcaacacttatgtcttcgggactgggaccaagatcaccgtcctaggtcagcccaaggcccaaccccactgtcta

SEQ ID NO: 784260 - DNA, 362 bp, Homo sapiens
  misc_feature: HIJSMM301A7KKZ.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttactaatcgggcctccggggtccctgacaggttcagtggcagtggatcga

SEQ ID NO: 784261 - DNA, 538 bp, Homo sapiens
  misc_feature: HIJSMM301DUZAD.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgtattattattgtagttcatataacaaccagtgactacgttgggtgttcgggcggagggaccaggctggaccgtccgtaggtcagcccaaggcctggcccccttcggtcacctctcgttcccaccctccc

SEQ ID NO: 784262 - DNA, 377 bp, Homo sapiens
  misc_feature: HIJSMM301EROR5.40.11.A11.1.454.light.4.raw
tctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtgccagcgggtctgggacagacttcactctcacca

SEQ ID NO: 784263 - DNA, 493 bp, Homo sapiens
  misc_feature: HIJSMM301BRMI0.13.39.D06.1.454.light.4.raw
tcacgtactacacgaccggtgctcgatttagtgacatctcgcagttcgtttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccgggtccctgaccgattcagtggcagcggtctgggacagatttcactctcaccatcagcagcctgcaggctgaagatgtggctagtttattactgtcagcaatattatagtactcctccgagctcactttcggcggtagggaccgaaggtggagatacaaacgaa

SEQ ID NO: 784264 - DNA, 505 bp, Homo sapiens
  misc_feature: HIJSMM301BW5FQ.13.11.A11.1.454.light.4.raw
  modified_base (431)..(431): a, c, t, g, unknown or other
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgccngatcgtcgaccgtggaccacggtcaccgtcgtaggtcacgacccaacggcccaaccccactcgtcactctcgtt

SEQ ID NO: 784265 - DNA, 507 bp, Homo sapiens
  misc_feature: HIJSMM301EIW9P.41.35.D02.1.454.light.4.raw
tctatactatcacgaccggtgctcgatttagcacacgatagttgggtttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctcttcggctccaggcggaggacgaggctgattactactgccttctcatatgcagaatactaagtcctgggtgttcggcgggaggaccaagctgaccgtcctaggtcagccaaggctcgcccctcggt

SEQ ID NO: 784266 - DNA, 494 bp, Homo sapiens
  misc_feature: HIJSMM301AWZAS.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcacggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtccg

SEQ ID NO: 784267 - DNA, 508 bp, Homo sapiens
  misc_feature: HIJSMM301BH13J.49.82.H05.1.454.light.4.raw
agtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggcgtggggacgaggctgattattattgctgttcatatgccgtgatagtggccgaagggtgttcggcgggagggaccgaaggtggaccgtcctaggtcacgcccaaggctcgccccctcggt

SEQ ID NO: 784268 - DNA, 517 bp, Homo sapiens
  misc_feature: HIJSMM301BBK3B.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggttcgtattctacttatgtcttcggaactgggaccaagggtccaccgtcctaggtcagccccgaacggcccaaccccactgtacctac

SEQ ID NO: 784269 - DNA, 522 bp, Homo sapiens
  misc_feature: HIJSMM301AL8Q5.15.59.F04.1.454.light.4.raw
tctacgtagccacgaccggtgctcgatttagtacacacacttagggattggggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccagggcagatgatgaatctgtttattattgtgtcctatataatgggtgcgtggctatttcggtctttcgggcggacgggaccaaggctgaccgtcctac

SEQ ID NO: 784270 - DNA, 496 bp, Homo sapiens; identical to SEQ ID NO: 572961
  misc_feature: HIJSMM301BO0O5.22.5.A05.1.454.light.4.raw

SEQ ID NO: 784271 - DNA, 533 bp, Homo sapiens
  misc_feature: HIJSMM301C0LFK.7.86.H09.1.454.light.4.raw
  modified_base (214)..(214): a, c, t, g, unknown or other
cgtgtctctacacgaccggtgctcgatttagtgctatagacttggggtttgggggagagctctggagaagagctgctcagttaggacccagagggaaccatggaaagcccagcgcagcttctcttcctcctgctactctggctcccagaggacgaccggagagattgtattgacgcagtctccaaccaccctgtctttgtctcctggggggganagccaccctctcctgcagggccagtgaaccttttagagtagttatttagcctggtatcggcaaaaacctggccaggctccccgactcctcttctttggtggagcctacagggccactggcaccccagacaggatcagtggcagcgggtctgggacagacttcattctcacccatcaacagactgcagcctgaagatattgcagtttactactgtcagcagtatgttacgtccccgtggacgttcggaccgaagggacccgaaaggtggcgaaatcaaaccgaactgtggcttggcaccatctgtcttcactcttccccg

SEQ ID NO: 784272 - DNA, 494 bp, Homo sapiens
  misc_feature: HIJSMM301E13LN.18.11.A11.1.454.light.4.raw
tacgagtatgcacgaccggtgctcgatttagctacgactgcaggggcgagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctcaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctcctctcacgttcggcggagggaccaaggtggagatcaaacgaactggtggctgcaccatcctgtcttcatccttcccgccat

SEQ ID NO: 784273 - DNA, 510 bp, Homo sapiens
  misc_feature: HIJSMM301CQGIJ.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccagctgaccgtcctaggtcagcccaaggctgcccctcggtcactc

SEQ ID NO: 784274 - DNA, 501 bp, Homo sapiens
  misc_feature: HIJSMM301EGWS0.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcgtcgtggtattcgggcggagggaccaagctgaccgtctaggtcagcccgaaggctccg

SEQ ID NO: 784275 - DNA, 510 bp, Homo sapiens
  misc_feature: HIJSMM301EIXMQ.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactcgtggggtcccagacagattcagcggcagtgggtcaggcactgatttcacactggaaatcagcagggtggaggctgaggatgttggggtttattactgcatgacaactacacacggccgctcactttcggcggagggaccgaaggtggagatcaaacgaactcgtggctgcaccatactgtt

SEQ ID NO: 784276 - DNA, 507 bp, Homo sapiens
  misc_feature: HIJSMM301BAOIG.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatggttggggtttattactgcatgcaaactacacacggccgctcacgtttcggcgggaggacaaggtggagatcaaacgaactgtggctgcaccatctgtt

SEQ ID NO: 784277 - DNA, 513 bp, Homo sapiens
  misc_feature: HIJSMM301A17U0.13.81.H04.1.454.light.4.raw
  modified_base (497)..(497): a, c, t, g, unknown or other
tcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagcaccctttatgtcttcgggactgtgaccaaggtcaccgtcctaggtcagcccaaggcccaaccccnctgtcactctgtccca

SEQ ID NO: 784278 - DNA, 495 bp, Homo sapiens; identical to SEQ ID NO: 710291
  misc_feature: HIJSMM301DJ4A3.4.27.C05.1.454.light.4.raw
  modified_base (462)..(462): a, c, t, g, unknown or other

SEQ ID NO: 784279 - DNA, 505 bp, Homo sapiens
  misc_feature: HIJSMM301D9RHD.40.67.G01.1.454.light.4.raw
  modified_base (494)..(494): a, c, t, g, unknown or other
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtgcagtgggtctgggacagccttcactctcaccatcagcagcctggacgcccgaagattttgcggttttattactgtcagcagcgtgccgactcggcccctcacgttcggcggagggaccaggtggacatcaaacgactgtggctgcaccatctgtcttnatcttcccgcc

SEQ ID NO: 784280 - DNA, 503 bp, Homo sapiens
  misc_feature: HIJSMM301ET6HU.19.78.H01.1.454.light.4.raw
tactctcgtgcacgaccggtgctcgatttagtgtgagtagtttgggtttggggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaatcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaaccccactgtcacttctcgttccccgccctccctccacgtagagta

SEQ ID NO: 784281 - DNA, 522 bp, Homo sapiens
  misc_feature: HIJSMM301CFDWC.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcggaccctgcccgattctcaggctccctccttggggcaaagctgccctgacactgtctggtgtgcagcctgaggacgaggctgactattactgcctactctactttggtggtgctgtgtctatttcggcggagggaccaagctgaccggtcttaagtcaggcccaaggctcgccccctcggtccacgtctcgttacccaccctcct

SEQ ID NO: 784282 - DNA, 480 bp, Homo sapiens
  misc_feature: HIJSMM301B604I.21.25.C03.1.454.light.4.raw
  modified_base (446)..(446): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaanaccctgcgtggttttgtcgtgttcggtcggcggg

SEQ ID NO: 784283 - DNA, 488 bp, Homo sapiens
  misc_feature: HIJSMM301AOJVK.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagttttatttactgtcagcagtatcatgactggccgctcaccttcggccaagggaccacgactggagattaaacgaactggtggctgcaccat

SEQ ID NO: 784284 - DNA, 516 bp, Homo sapiens
  misc_feature: HIJSMM301AUNP5.40.12.B01.1.454.light.4.raw
  modified_base (432)..(432): a, c, t, g, unknown or other
  modified_base (487)..(487): a, c, t, g, unknown or other
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctcctgaccgtctcgtgggctccaggctgaagatgaggctgattattactgctactcgtatgcaggcgnaacaattgggtcttggcggagggaccaagctgaccgtcctaggtcagccaaggcncgccccctcggtcactctcgtccctcccc

SEQ ID NO: 784285 - DNA, 513 bp, Homo sapiens
  misc_feature: HIJSMM301A206W.18.59.F04.1.454.light.4.raw
  modified_base (448)..(448): a, c, t, g, unknown or other
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcacacggcctccctgaccatctctgggcctccaggctgaggacgaggctgattattactgcagctcatatacaagcaccagcactctctntgtcttcggaactgggaccaaggtccaccgtcctacggtcacgacccaacggccaaccccctacc

SEQ ID NO: 784286 - DNA, 520 bp, Homo sapiens
  misc_feature: HIJSMM301CXNVC.13.81.H04.1.454.light.4.raw
  modified_base (498)..(498): a, c, t, g, unknown or other
tcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagctaccctttatgtcttcgggactgtgaccaaggtcaccgtcctaggtcagcccaaggcccaaccccnctcgtcactttcgtccgtccct

SEQ ID NO: 784287 - DNA, 539 bp, Homo sapiens
  misc_feature: HIJSMM301ASGEM.40.27.C05.1.454.light.4.raw
tctagcgactcacgaccggtgctcgatttagacgcgatcgaagggtttggggagcttcagctgtggtggagaagacaggattcaggccaatctccagcatggccggcttccctctcctcctcaccctcctcactcactgtgcagggtcctgggcccagtctgtgctgactcagccaccctcagcgtctgagaccccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctcccaggtctggcacctcagcctccctggccatcagtgggctccggcccgaggatgaggcggattattattgtgtgtcatgggatgacagaagtagaattaggtccggtggtttcggcgggagggaccgaggcgtgaccgtcctaggtcgacgcccaacggctcgccccccgtcggtccgactcttcg

SEQ ID NO: 784288 - DNA, 499 bp, Homo sapiens; identical to SEQ ID NO: 543098
  misc_feature: HIJSMM301APJ3X.18.59.F04.1.454.light.4.raw

SEQ ID NO: 784289 - DNA, 488 bp, Homo sapiens
  misc_feature: HIJSMM301EQD4P.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaacgtcccgctcacttcggcggagggaccgaaggtggagatcaaacgtaacg

SEQ ID NO: 784290 - DNA, 496 bp, Homo sapiens
  misc_feature: HIJSMM301B1OA0.41.76.G10.1.454.light.4.raw
tctatactatcacgaccggtgctcgatttagtcactcatacagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgtcgggccagtcagagtattagtggctggttggcctggtatcagcagacaccagggaaagcccctaagctcctgatccataaggcatctaatttagaaagtggggtcccatcaaggttcagcggcagtggatctgggacagaattcactctcaccatcagcagcctgcagcctgatgtattttgctaacttattactgccagcaatatcatagttccttcttcggacgttcggtaccgaagggaaccgaacggtaggtacgatacaaacgaactaggtggtcgtgcgaccta

SEQ ID NO: 784291 - DNA, 513 bp, Homo sapiens
  misc_feature: HIJSMM301AXCEY.10.75.G09.1.454.light.4.raw
catagtagtgcacgaccggtgctcgatttagtatagacatcagggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcacgccaagctcgccccctcggtcactctcgttcccgt

SEQ ID NO: 784292 - DNA, 441 bp, Homo sapiens
  misc_feature: HIJSMM301AKCUP.43.23.C01.1.454.light.4.raw
tgtgagtagtcacgaccggtgctcgatttagtacacgtgattagggattgggggtgattagggattgggggttgagaacctatgaacattctgtaggggccacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcaccctgaggacgaggctgagtattactgtctgctcccactttcgtactgcctgggtcgttcgggcgggggactcagttgaccgtccgtgggtcagcccaggctcgccccctcggtcactctcgttcccaccctcctcactactcaca

SEQ ID NO: 784293 - DNA, 521 bp, Homo sapiens
  misc_feature: HIJSMM301C0XE2.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttgggggcaaagctgccctgacactgtctggtgtgcagcctgaggacgaggctgactattactgcctactctactttggtggtgctgtgctattcggcggagggaccaagctgaccgtcttaagtctagcccaacggctcgcccccgtcggtcactctcgttcccaccctccctcgactacgg

SEQ ID NO: 784294 - DNA, 487 bp, Homo sapiens
  misc_feature: HIJSMM301CBOXF.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcacgcccaaggccaacccc

SEQ ID NO: 784295 - DNA, 501 bp, Homo sapiens
  misc_feature: HIJSMM301AH7CC.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggagggaccgagggtggaggatacaaacgaactggtggctgcaccatctgtcttcattccc

SEQ ID NO: 784296 - DNA, 500 bp, Homo sapiens
  misc_feature: HIJSMM301DUNT3.3.33.C11.1.454.light.4.raw
  modified_base (498)..(498): a, c, t, g, unknown or other
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgtttcgcggagggaccaagctagaccgtcctaggtcacgcccaagctcgccccctcggtcactcctgttcccaccctcctcgagtgcgtctntc

SEQ ID NO: 784297 - DNA, 497 bp, Homo sapiens
  misc_feature: HIJSMM301D5WJX.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccagtctggcaacacggcctcctgacaatctctgggctccaggctgaggacgaggctgattactactgctgctcatatgcaggtcgtatctcttatgtcttcggactgggaccaaggtcaccgtctaggtcagccaggcccaacccact

SEQ ID NO: 784298 - DNA, 501 bp, Homo sapiens
  misc_feature: HIJSMM301CGPB9.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatcccggggtccctgaccgattcagtggcagcgggtctgggacagattttcactctcaccatccagcagcctgcaggctgaagatgtggcagtttattattgtcagtcaatattatattccctcctcagacgttcggccaaggaccaagtggaaatcaaacgactgtggctgcaccta

SEQ ID NO: 784299 - DNA, 521 bp, Homo sapiens
  misc_feature: HIJSMM301CEHGO.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggccagggaccgaaggtaggaagtacaaacgaactagtaggctgcgaccactactcgtcgttcctacttccttcccgtcccgact

SEQ ID NO: 784300 - DNA, 511 bp, Homo sapiens
  misc_feature: HIJSMM301CI62P.21.15.B04.1.454.light.4.raw
  modified_base (443)..(443): a, c, t, g, unknown or other
tcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctccgacaataagaactacttagcttggtaccagcagcaaccaggacaacgtcctaaattgctcatttactgggcatctgtccgggaatccggggtccctgaccgattcgttggcagcgggtctgggacagatttcactctcaccatcagcacgcctacagggctgaagatgtggctagttttatttttgtatgcaactattatgccnctccgctcactttcggcggagggaccaaggtggagatacaaacgaactgtggcttgcacctatcttcg

SEQ ID NO: 784301 - DNA, 510 bp, Homo sapiens
  misc_feature: HIJSMM301BZMAK.21.81.H04.1.454.light.4.raw
  modified_base (438)..(438): a, c, t, g, unknown or other
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcataatacaatcagcaaanacttatgtcttcgggactgggaccaagaatcaccgtcctaggtcacgcccaaggcccaaccccactcgttca

SEQ ID NO: 784302 - DNA, 443 bp, Homo sapiens
  misc_feature: HIJSMM301CTCEO.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtattggctgttcggcggcgggaccaagttgaccgtctacgtcagcccaaggctgccccctcggcactctcgttccccaccctcctcgacacgcgag

SEQ ID NO: 784303 - DNA, 506 bp, Homo sapiens
  misc_feature: HIJSMM301D9NG1.53.49.E05.1.454.light.4.raw
cgcgtatacacacgaccggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcagttcggcggagggaccgaagctgaccgtcctgggtcagcccaaggctgccccctcggtcaccgt

SEQ ID NO: 784304 - DNA, 499 bp, Homo sapiens
  misc_feature: HIJSMM301DP3VS.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtctgggtcagccaagctgcccctcggt

SEQ ID NO: 784305 - DNA, 511 bp, Homo sapiens
  misc_feature: HIJSMM301DAAJC.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagcctcatatacaaggagcaaccactctcgtggtatttggtggagggaccaagctcgaccgtcctaggtcacgcccaaggctcgccccctcggt

SEQ ID NO: 784306 - DNA, 496 bp, Homo sapiens
  misc_feature: HIJSMM301BN5YT.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctggggacagacttcactctcaccatcagcagactggagcctgaagattttgcagtctattactgtcagcagtatggtccacgtaccctaagaacgttttaggtccaggggaccaaggctaggagatcaaacgaactgtggctgcaccagt

SEQ ID NO: 784307 - DNA, 492 bp, Homo sapiens
  misc_feature: HIJSMM301CTN17.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagatcagcggcagtggcactgatgtcacactgacaatcagcagggtggaggctgaggatgttggggtttgttcctccatgcaaggtacacactggccttttggccaggggaccaacctcggagatcaaatgaactgtggctgcacatctgtctt

SEQ ID NO: 784308 - DNA, 503 bp, Homo sapiens
  misc_feature: HIJSMM301EZ01U.15.31.C09.1.454.light.4.raw
tctacgtagccacgaccggtgctcgatttagacgtctcatcaaggaaggaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctccctgaccatctctgggctccaggctgaggacgaggctgattattactgcagctcatatacaagcagcagcactccttgggtgttcggcgggagggaccaagctgaccgtcctaggtcagcccaaggtcccg

SEQ ID NO: 784309 - DNA, 504 bp, Homo sapiens
  misc_feature: HIJSMM301D1R27.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctcaagtctggcagaacggcctcctgaccgtctctgggctccaagctgagatgaggctgattattactgcagctcatatgcaggcagcagcaatgtacttttcggcggagggaccaagctgaccgtccgtggtcagcccaaggctcgccccctggtcctacc

SEQ ID NO: 784310 - DNA, 516 bp, Homo sapiens
  misc_feature: HIJSMM301C6MV8.19.85.H08.1.454.light.4.raw
tactctcgtgcacgaccggtgctcgatttagtatcactcagtcgcggggctccaaacagagcttcagcaagcatagtgggaatctgcaccataccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaaggacacaaaatacagcctctctgaccattactggtctcagcctgacgacgaggctgactactactgctcagcctgggacaccagcctcgctgcgttggtcttttcggcggagggaccaagctgaccgtccgtggtcacgcccgaacggctcgcccccgtcggtcctacc

SEQ ID NO: 784311 - DNA, 491 bp, Homo sapiens
  misc_feature: HIJSMM301E4BQI.9.1.A01.1.454.light.4.raw
  modified_base (406)..(406): a, c, t, g, unknown or other
  modified_base (489)..(489): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcaagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcngcagtatcataggtcaaacaccttcggtcaagggacacgactaggagattaaaggtaactagtggctgcaccaatctgtcttnta

SEQ ID NO: 784312 - DNA, 485 bp, Homo sapiens
  misc_feature: HIJSMM301CP4QH.16.12.B01.1.454.light.4.raw
  modified_base (55)..(55): a, c, t, g, unknown or other
tgtactactccacgaccggtgctcgatttagtagtgtagattcggcgggggtcanactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatcgtggatatcaaacgaactgtggctgcaccatctgtctta

SEQ ID NO: 784313 - DNA, 507 bp, Homo sapiens
  misc_feature: HIJSMM301CD3RT.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagtatttctaatcgggattccggggtcccagacagattcagcggcagtgggtcaggcactgatttcacgctgaagatcagcagggtggaggctgaggatgttgtcggtttattactgcctgcagagtatcactggccgtggacgttcggccgaagggaccgaaggtaggaaatacaaacgaactgtggctgcaccatcg

SEQ ID NO: 784314 - DNA, 489 bp, Homo sapiens
  misc_feature: HIJSMM301EB0Z3.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaacccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagacttttaggccagggaccgaagctggagatcaaacgaactagtggctgctaccat

SEQ ID NO: 784315 - DNA, 492 bp, Homo sapiens
  misc_feature: HIJSMM301D7905.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctggtaccaacagaccccaggccagcctccacgcacgctcatctatagcacaaacactcgctcttctggggtccctgatcgcttctctggctccatccttggaaacaaagctgccctcaccatcacggggcccaggcagatgatgaatctgtttatattgtgtcctatatatgggtgctggctatttcggtcttcggcggagggaccaagctgaccgtcctaggtcagcccaaggctcgcccctcggtcactctgttcccgccctcctcgctacgtaga

SEQ ID NO: 784316 - DNA, 510 bp, Homo sapiens
  misc_feature: HIJSMM301C3K5X.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcaggtgggtctgggacttcgttcactctcaccatcaataacctgcaatctgacgactttgctagtttatttctgtcagcagtctgaagactggccgttcactttcggcggagggaccaagggtggacctacaaacgaactgtggctgcaccatctgtcttcatcttcccgcca

SEQ ID NO: 784317 - DNA, 515 bp, Homo sapiens
  misc_feature: HIJSMM301CLW9Z.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtccactctgtcccgt

SEQ ID NO: 784318 - DNA, 498 bp, Homo sapiens
  misc_feature: HIJSMM301AFDUK.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcaggtgggtctgggacagacttcactctcaccatcagcagactggagcctgaggattttgcagtgtattactgtcagcagtatacataggtcaaacaccttcggccgaaggacacgactggagattaaaggaactgtggctgcaccatctgtcttctactcttccccg

SEQ ID NO: 784319 - DNA, 485 bp, Homo sapiens
  misc_feature: HIJSMM301B2417.5.42.D09.1.454.light.4.raw
atcagacacgcacgaccggtgctcgatttagacacatacgcagggaaaggggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgaccaacaatataatagttattggacgttcggccgagggacgaaggtacgaatgagacgaacgtgtaggctgcacatct

SEQ ID NO: 784320 - DNA, 508 bp, Homo sapiens
  misc_feature: HIJSMM301DQ8JZ.15.49.E05.1.454.light.4.raw
  modified_base (370)..(370): a, c, t, g, unknown or other
  modified_base (393)..(393): a, c, t, g, unknown or other
tctacgtagccacgaccggtgctcgatttagagcgactagcaacacacgaaaggggggaggaactgctcagttaggacccagacggaaccatggaagccccagcgcagcttctcttcctcctgctactctggctcccagataccactggagaaatagtaatgacgcagtctccagccaccctgtctgtgtctccagggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcatttcncaccatcagcagcctgcagttcngaagattttgctagtttattactgtcagcagtataatgactggcctccgacgttcggccgaagggaccaaggtacgggaaatacaaacgaactaggtcggctgcaccactcttcg

SEQ ID NO: 784321 - DNA, 510 bp, Homo sapiens
  misc_feature: HIJSMM301EIZFO.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggcctccaggctgaggacgaggctgattactactgctgctcatatgcaggtcgtatctcttatgtcttcggaactgggaccaaggtccaccgtcctaggtcagcccgaaggcccaaccccactgtcctac

SEQ ID NO: 784322 - DNA, 504 bp, Homo sapiens
  misc_feature: HIJSMM301AXDV2.49.20.B09.1.454.light.4.raw
agtcgagagacacgaccggtgctcgatttagtgtagtgtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccgccagaggacgaggctgactattactgtcagtccgcagacagcagtggcagttatgtcgtagtttcggcgggagggactacgctcgaccgtcctaggtcagacccaaggcctcgcccccgtacggtcacttccg

SEQ ID NO: 784323 - DNA, 470 bp, Homo sapiens
  misc_feature: HIJSMM301AKVUV.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgagtgcatatgaagagaactgtgg

SEQ ID NO: 784324 - DNA, 517 bp, Homo sapiens
  misc_feature: HIJSMM301ALCZ5.9.53.E09.1.454.light.4.raw
tgatacgtctcacgaccggtgctcgatttagagagagtgtgttgggtttgggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagccggccctcaggggtttctattcgcttctctggctccaagtctgacaacacggcctccctgacaatctctgggctccaggctggaggacggaggctgattattactgctgctcatatgcagatggtgaccacttccccggtggtattcgggcgggaggggaccaaggtgacccgtctaggtcagcccaaggctcgtccccccg

SEQ ID NO: 784325 - DNA, 520 bp, Homo sapiens
  misc_feature: HIJSMM301AEQQ8.53.20.B09.1.454.light.4.raw
cgcgtatacacacgaccggtgctcgatttagtgtagtgtgaaggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccacccctgaccatcagcagggtcgaaggccggggacgaggccgactattactgtcaggtgtgggattttaatagtgatcattgggtgttcggcggagggaccaagctgaccgtcctaggtcagcccaaggctgccccctccggtcactctgttcccgccctccctctcgta

SEQ ID NO: 784326 - DNA, 493 bp, Homo sapiens
  misc_feature: HIJSMM301DAL4F.22.14.B03.1.454.light.4.raw
  modified_base (491)..(491): a, c, t, g, unknown or other
acatacgcgtcacgaccggtgctcgatttagtgtgagtagttccgcgggggagctacaacaggcaggcaggggcagcaagatggtgttgtagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccgggtccctgaccgattcagtggcagcgggtctgggacagatttcactcctcaccatcagcagcctgcaggctgaagatgtggctagtttattattgtcagacaatattatacttcctcctcagtacgttcggcaagggaccaaggtaggaaatcaaacgaactgngc

SEQ ID NO: 784327 - DNA, 531 bp, Homo sapiens
  misc_feature: HIJSMM301BZ889.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaactcggccctcgaggggtttctaatcgcttctctggctccaagtctggcaacacggccctccctgacccatctctgggctccaggctggaggacgaggctgattattactgcagctcatatacaagcaccagccactcctctatgttcttacggaacgttgggaacctaagggtccacccggttcctaacggttcaacgccccgaaacggacccccc

SEQ ID NO: 784328 - DNA, 517 bp, Homo sapiens
  misc_feature: HIJSMM301E1SHI.9.71.G05.1.454.light.4.raw
tgatacgtctcacgaccggtgctcgatttagtgtcgtcgcaagagagaggggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagacggccctcaggggtttctggtcgcttctctgcctccaagtctggcaacacggcctccctgacaatctctgggctccagtctgacgacgaggctgattattactgcagctcatatgcagtttcggttccttcttttcaagtatattccggcgggagggaccaggctgaccgtcctgagtcacgcccaaggcctcgtccccccg

SEQ ID NO: 784329 - DNA, 520 bp, Homo sapiens
  misc_feature: HIJSMM301BF9V3.15.86.H09.1.454.light.4.raw
  modified_base (517)..(517): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatgggccaagtacgggttggggtgttcgggcggagggaccaagctgaccgtcctaggtcagcccaaggctggccccctggtcactctgttcccaccctcctcgctacgtanacg

SEQ ID NO: 784330 - DNA, 499 bp, Homo sapiens
  misc_feature: HIJSMM301C070K.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccagggggagagagcccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtattactgtcagcagtatcataggtcaaacaccttcggccaagggacacgactggagattaaaggaactagtggctgcaccatctgtcttcactcttccccg

SEQ ID NO: 784331 - DNA, 541 bp, Homo sapiens
  misc_feature: HIJSMM301C6IBK.27.23.C01.1.454.light.4.raw
  modified_base (454)..(454): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacgttgggtgttcggnggagggaccaggctcgaccgtaccgtaggtcagccctaagggctcgccccctcgggtccaccgttctcggttacccacccttccccg

SEQ ID NO: 784332 - DNA, 527 bp, Homo sapiens
  misc_feature: HIJSMM301A286L.41.14.B03.1.454.light.4.raw
tctatactatcacgaccggtgctcgatttagtgtgagtagttccggcgggggggggtctcaggaggcagcgctctcgggacgtctccaccatggcctgggctctgctattcctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggcgagggtgattattctgcagctcatttacaaccagccacaccttgctcttcggaactgggaccacggtcatcgtcctaggtcagcccaaggcccaaccccacctgtcactctcgttcccaccctcctcta

SEQ ID NO: 784333 - DNA, 501 bp, Homo sapiens
  misc_feature: HIJSMM301BDFXU.40.83.H06.1.454.light.4.raw
tctagcgactcacgaccggtgctcgatttagatcacgtgcgtcgcggggctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggacctcaagcctgaggacgaggctgactattactgttcagcagtgggacggacacgccgtcatggaagtggggtggttcgggcggagggaccgaaacgtcgttccgtcccgtacggtacacc

SEQ ID NO: 784334 - DNA, 514 bp, Homo sapiens
  misc_feature: HIJSMM301CN7AM.22.21.B10.1.454.light.4.raw
acatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctggcctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgatttattactgctactcatatgcaggcggcaactcgttgggtgttcggcggagggaccaagctgaccgtccgtaggtcagacccaaggctcgccccctcggtccactcttccg

SEQ ID NO: 784335 - DNA, 507 bp, Homo sapiens
  misc_feature: HIJSMM301EVVI9.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcgggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcactcc

SEQ ID NO: 784336 - DNA, 495 bp, Homo sapiens
  misc_feature: HIJSMM301AJOA1.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacacgcctcctaagctgctcatttactgggcatctatccgggaatccggggtccctgaccgattcagtggcagcgggtctgggacagatttcactctcaccatcagcagcctgcaggctgaagatgtggctagtttattactgtcagcaatattatagtactcctccgaggctctacgtttcggcgggacgggaccgaagggtggagatacaaacgaac

SEQ ID NO: 784337 - DNA, 497 bp, Homo sapiens
  misc_feature: HIJSMM301CLT20.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatactgggacagaattcactctcaccgtcagcagcctgcagcctgaagattttgcaacttattactgtcaacagtttaataactaccctctcactttcgaggagggaccgagggtggagatcaaacgaactagtggctgcaccatcctagtcttcta

SEQ ID NO: 784338 - DNA, 499 bp, Homo sapiens
  misc_feature: HIJSMM301BPKQE.5.12.B01.1.454.light.4.raw
atcagacacgcacgaccggtgctcgatttagtagtgtagattccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgtagttttcggcggagggaccaagctgaccgtcctgagtcacgccaaggctccg

SEQ ID NO: 784339 - DNA, 490 bp, Homo sapiens
  misc_feature: HIJSMM301DJSKD.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtcccaagtaacttttggaccgtaggggaccaagctggagatcaaacgaactgtggctgcaccat

SEQ ID NO: 784340 - DNA, 482 bp, Homo sapiens
  misc_feature: HIJSMM301DLVT6.21.25.C03.1.454.light.4.raw
  modified_base (443)..(443): a, c, t, g, unknown or other
  modified_base (452)..(452): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcgctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatcganaacaccctncgtggtttttggctgttcggcggcgggacc

SEQ ID NO: 784341 - DNA, 522 bp, Homo sapiens
  misc_feature: HIJSMM301AL602.5.24.C02.1.454.light.4.raw
  modified_base (380)..(380): a, c, t, g, unknown or other
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtcnctgggctccaggctgaggatgaggctgatttattactgcagctcatatgcaggcagcagcacgtccccatgtgatcgttcgggcggggggaccaaggctggacccgtccgtaggtccagccccgaaggccgtcgtccccccg

SEQ ID NO: 784342 - DNA, 517 bp, Homo sapiens
  misc_feature: HIJSMM301CRSC0.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgttggttagtttggtggagggaccaaggctggacccgtccgtaggtcacgcccaaggcctcgccccctcggt

SEQ ID NO: 784343 - DNA, 524 bp, Homo sapiens
  misc_feature: HIJSMM301ANYV6.19.72.G06.1.454.light.4.raw
  modified_base (421)..(421): a, c, t, g, unknown or other
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacatctctgggctccaggctgaggacgaggctgactattattgctgcncatacgcaggaagtagcacatgggtgtggcggcgggacgggaccaagggtgaccgtccgtgggtcagccccaaggcctcgccccccgttcggtccacttcccg

SEQ ID NO: 784344 - DNA, 504 bp, Homo sapiens
  misc_feature: HIJSMM301EXAJ1.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtatttgcagtgtattactgtcagcagtatcataggtacaaacaccttacggccaagggacacgacgtggagacgttaaaggaactaggtggctagcaccatctagtcttcactcttccccg

SEQ ID NO: 784345 - DNA, 500 bp, Homo sapiens
  misc_feature: HIJSMM301CFS70.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctctactttcggcggagggaccgagggtggaggatcgaaacgaactgtggctgcaccatctgtcttctattcc

SEQ ID NO: 784346 - DNA, 492 bp, Homo sapiens
  misc_feature: HIJSMM301CZT70.5.39.D06.1.454.light.4.raw
  modified_base (490)..(490): a, c, t, g, unknown or other
atcagacacgcacgaccggtgctcgatttagtgacatctcgcagttctttggggggagtcagactcaatcaggacacagcatggacatgagggtccccgctcagctcctggggctcctgctgctctggctcccaggtgccgagggtgacatccagctgacccagtctccctccaccgtgtctgcatcccgtaggagacagagtcaccatcacctgccgggccagtcagaatattaatagttggttggcctggtatcaccagaggccaggagaggccccaaagctccttatttatgatgcctccactttgattagtggggttcccaccaacgttcagcggcagtggatctgggacagagttcactctcaccatcagcagcctgcagcctgatgatcttggaactttattactgccaacaatataattagttattaggacgttcggccaggggacgaaggtcgaaagttgagacgaaactgtggctgcaccnta

SEQ ID NO: 784347 - DNA, 496 bp, Homo sapiens
  misc_feature: HIJSMM301AJN4Q.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatcttatttgggttctaatcgggcctccggggtccctgacaggttcagtggcagtggatcaggcacagattttacactagaaaatcagcagagtggaggctgaggatggttggggtttattactgcatgcaagctctacaaactccttactcttttggccgaggggaccaagctggagaatacaaacgaactg

SEQ ID NO: 784348 - DNA, 492 bp, Homo sapiens
  misc_feature: HIJSMM301A2FXA.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaaacagtaatacttaatcttttatgtcttcggatctgggaccagggtccaccgttcctaggtcagcccaaggcccaacccc

SEQ ID NO: 784349 - DNA, 505 bp, Homo sapiens
  misc_feature: HIJSMM301EJHYT.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctcaagtctggcaacacggcctccctgaccatctctgggctccaggctgatgacgagctgattatactgcaggtcatatacaatcaagcaacacgttatgtcttcgggactggaccaagactcaccgtcctaggtcacgcccaaggcccaaccccactcgtcta

SEQ ID NO: 784350 - DNA, 490 bp, Homo sapiens
  misc_feature: HIJSMM301DG0X7.7.75.G09.1.454.light.4.raw
  modified_base (387)..(387): a, c, t, g, unknown or other
  modified_base (477)..(477): a, c, t, g, unknown or other
cgtgtctctacacgaccggtgctcgatttagtatagacatcaggggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggnttttgcaacttactactgtcagcaggctaacaggctcgcccccaaccttccggccgaggggacacgactggagattaaacgaactgtggntgcaccatctgtt

SEQ ID NO: 784351 - DNA, 511 bp, Homo sapiens
  misc_feature: HIJSMM301DUI1M.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggaccagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattacttgcagctcatatgcaggcagcagcagtccccatgtgatcttcggcggggggaccaagctgaccgtcctaggtcagcccaaggctcgtccccccg

SEQ ID NO: 784352 - DNA, 502 bp, Homo sapiens
  misc_feature: HIJSMM301DYN4I.52.38.D05.1.454.light.4.raw
cgcagtacgacacgaccggtgctcgatttagtatctgatagttgggtttggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcaggaggacgaggctggactattattgtcaatcaacagacaccattggtacttatgtctttcggaactgacgaccaaggtcaccgtcctgggtcagcccaaggcccaaccccactgtcact

SEQ ID NO: 784353 - DNA, 505 bp, Homo sapiens
  misc_feature: HIJSMM301D465F.5.71.G05.1.454.light.4.raw
atcagacacgcacgaccggtgctcgatttagtgtcgtcgcaagagagaggggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtgtcttacacagctccagcaataagaaccacttagcttggtaccagcagaaaccaggacagcctcctaaggtactcatttactgggcatcctacccggggatccggggtccctgaccgattcagtggcagcgggtctgggacagacttcactctcaccatcagcagtctgcaggctgaagatgtggctagtttattactgtcagcaattattaataccactccgtgaccgtagttttcgggcctggggaccaaaggcctaggacgatacaaacgaactt

SEQ ID NO: 784354 - DNA, 518 bp, Homo sapiens
  misc_feature: HIJSMM301E182R.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgacccatcagcagggtcgaagccggggatgaggccgactattactgtcaggtgtgggagtagtagtggtgatcatccatacgtcttcggaacgtaggacctaacggctccgtccgtacgtcagcccaacggccaaccccactacgtcactctcgttccta

SEQ ID NO: 784355 - DNA, 501 bp, Homo sapiens
  misc_feature: HIJSMM301EYK70.40.33.C11.1.454.light.4.raw
tctagcgactcacgaccggtgctcgatttagagtgagctcgttggggtttgggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacggggcccagccagaggatgagtcttattattactgcatgctccatgtgggggtgcacttgggtgttcggcggagggaccaagctgaccgtcctaggtcagcccaaggctgcccctc

SEQ ID NO: 784356 - DNA, 526 bp, Homo sapiens
  misc_feature: HIJSMM301EDFX2.3.87.H10.1.454.light.4.raw
agacgcactccacgaccggtgctcgatttagcagtactgcgttgggtttgggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgtcttttctggctccaagtctggcaacacggcctccctgaccatctctgggctccaggctgaggacgaggctgatttatttctgcagctcatacacaaccggcaccactgtcgtggttttcggtggtaggaccaagctgaccgtcctaggtcagcccaaggcctcgccccctcggtcacttccg

SEQ ID NO: 784357 - DNA, 505 bp, Homo sapiens
  misc_feature: HIJSMM301EP03C.26.12.B01.1.454.light.4.raw
agactatactcacgaccggtgctcgatttagtagtgtagattccgcgggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagttgttagtaacaacttagcctggtaccagcagaaacctggccaggctcccaggctcctcatctctggtgcatccaccagggccactggtatcccgggccagattcagtggcagggggtctggggacaggaattcactctcaccatcaccagcctgcagtctgaagattttgcagtctattactgttcagcaatataattactggctctctttcggcgggggaccaagctggagactacaaccgaactgtagcttgcaccgatctgtt

SEQ ID NO: 784358 - DNA, 515 bp, Homo sapiens
  misc_feature: HIJSMM301E1UWF.9.21.B10.1.454.light.4.raw
  modified_base (362)..(362): a, c, t, g, unknown or other
tgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgccccacactcttaatttatgaggtcactaagcggccctcaggggtttctggtcgcttctctgcctcaagtctggcaacncggcctcctgacaatctctgggctccagtctgacgacgaggctgattattactgcagctcatatgctagttggttcctctttcaagtatagttcgggcggagggaccagggctcgaccggttcctggagttcagcccaaggcctcgccccccg

SEQ ID NO: 784359 - DNA, 491 bp, Homo sapiens
  misc_feature: HIJSMM301BNLSC.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctggggacaggatttcactctcaccatcagcagcctgcaggctgaagatgtggcagtttattattgtcaacaatattattatacttcgtggacgttcggccaagggaccaaggtaggagtaatcagacgaa

SEQ ID NO: 784360 - DNA, 509 bp, Homo sapiens
  misc_feature: HIJSMM301DO57F.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccacagcacccaggcaaagcccccaaactcattatttatgaggtcaataatcggccctcaggagtttctaatcgcttctctggctccaagtctggcaacacggcctccctgagcatctctgggctccaggctgaggacgaggctgatttattactgcagctcatatactattagcagaacttgtggttttcggacggagggaccaaggtgaaccgtcctaggtcagccaagctcgccccctcggtcactcttccg

SEQ ID NO: 784361 - DNA, 451 bp, Homo sapiens
  misc_feature: HIJSMM301AJUDG.18.73.G07.1.454.light.4.raw
tacgagtatgcacgaccggtgctcgatttagctctacgctcagggtcctgggcccagtctgggctgacgcagccgccctcactgtctggggcccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctccctggccatcactgggctccaggctgatgatgaggctgattattactgccagtcctatgacactaatctcagtggtctgggggtcttcggcggagggaccaggctgaccgtcgtgggtcagcccaaggctcgccccctcggtcactctcgttccccgccctcctccatactcgta

SEQ ID NO: 784362 - DNA, 506 bp, Homo sapiens
  misc_feature: HIJSMM301AZSV7.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccacttcggccctgggaccaaagtggatatacaaacgaactgtggctgcaccatctgtctt

SEQ ID NO: 784363 - DNA, 462 bp, Homo sapiens
  misc_feature: HIJSMM301B3RUH.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctggatgacagtgtgaacggttccggttttcgggcggagggaccaagctgaccgtcctaagtcagcccaaggctcgccccctcggtcactctcgttccccacccctcctcccacgagagtta

SEQ ID NO: 784364 - DNA, 520 bp, Homo sapiens
  misc_feature: HIJSMM301CBSJ8.7.34.D01.1.454.light.4.raw
  modified_base (362)..(362): a, c, t, g, unknown or other
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaacatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacncggcctccctgaccatctctggacctccagactgagggacgaggctgattattactgctgctcatatacgaggggacagcatttagtttggggttgttcgggcgggagggaccaagctgaccgtcctgcgtcacgccaaggctcgccccctcggtcac

SEQ ID NO: 784365 - DNA, 520 bp, Homo sapiens
  misc_feature: HIJSMM301DV1A5.47.53.E09.1.454.light.4.raw
agctcacgtacacgaccggtgctcgatttagagagagtgtgttggggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggcccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtctcggtcagcccaaggctgccccctcggtcacgtctgttcccgccctcctc

SEQ ID NO: 784366 - DNA, 505 bp, Homo sapiens
  misc_feature: HIJSMM301AWDPK.9.12.B01.1.454.light.4.raw
tgatacgtctcacgaccggtgctcgatttagtagtgtagattcggcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtcccccaaactcatgatttatgaggtcaataagcggccctctggggtccctgatcgcttctctggctccaagtctggcaacacggcctccctgaccgtctctgggctccaggctgacgatgaggctgattatactgcagctcatatgcaggcacccacaatgtcttcggaagtggaccacggtcaccgtctaggtcagcccaaggccaaccccactgtcacttccg

SEQ ID NO: 784367 - DNA, 498 bp, Homo sapiens
  misc_feature: HIJSMM301AQ838.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacaggagttcactctcaccatcagcagcctgcagtctgaagattttgcggttattactgtcagcagtataataactggcctccacggtacactttggtccagggggaccaagctggagatcaaacgaactgtggctgcaccatctgtt

SEQ ID NO: 784368 - DNA, 518 bp, Homo sapiens
  misc_feature: HIJSMM301B7WBG.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagtattttgtcagtttattacttgtcaacagcgtagcagcaggcctccggccgacgttcggccaagggaccgaaggtggaagtcaagcgaactgtggctgcaccatctcgttcttcattcttcccccgcc

SEQ ID NO: 784369 - DNA, 496 bp, Homo sapiens
  misc_feature: HIJSMM301ADU23.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggtccagggggaccaacctcggagatcaaatgaactgtggctgcaccatctgtctt

SEQ ID NO: 784370 - DNA, 498 bp, Homo sapiens
  misc_feature: HIJSMM301CKB9S.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggcaagggaccaaggtggaaatacaaacgaactgtgctgcacca

SEQ ID NO: 784371 - DNA, 534 bp, Homo sapiens
  misc_feature: HIJSMM301EJQA5.43.1.A01.1.454.light.4.raw
tgtgagtagtcacgaccggtgctcgatttagacgtctcatcaggggggggggaagctcagtttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcttgttctggaagcagttccaacatcggaagtaataatgtgaattggtaccggcaactcccaggaaccggcccccaaactcctcatgcatagtaatgatcatcggccccaggggtccctgaccgaatctctggctccaggtctggcgcctcagcctccctggtcatcagtgggctccaatctgaggatgaggctgactattactgttcagcgtgggatgccagcccgaatcggttgggtgttcgggtcggacgggaccaaacgtgaccgtccgtacggtcacgcccaagggcctcgtcccccgtcggtccg

SEQ ID NO: 784372 - DNA, 513 bp, Homo sapiens
  misc_feature: HIJSMM301B8QNN.48.17.B06.1.454.light.4.raw
  modified_base (239)..(239): a, c, t, g, unknown or other
agtatacatacacgaccggtgctcgatttagtcgatagtgaagggggctggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatntaaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccagacctgaccgtcctacggtcagcccaaggctgccccctcgtcactctcgt

SEQ ID NO: 784373 - DNA, 513 bp, Homo sapiens
  misc_feature: HIJSMM301CQWEK.10.29.C07.1.454.light.4.raw
catagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctctaggggtttctaatcgcttctctggctccaagtctggcaacacggcctccctgaccatctctgggctccaggctgaggacgaggctgattattactgcagctcatatacaaccagcagcacctctgtattcgggcggaggggaccaagctgaccgtcctaggtcacgcccaaggctcgccccctcggtccta

SEQ ID NO: 784374 - DNA, 512 bp, Homo sapiens
  misc_feature: HIJSMM301A45II.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagccccaggcccctgtgttggtgatgtataaagacagtgagaggccctcagggatccctgagcgattctctggcgccagctcaggaacagtagtcacgttgaccatcagtggagtccaggcagaagacggaggctgactattattgtacaagcagtagacagcagttcgtccttagttcgggtcggttcgggccgggggaccaaggcgtcgaccgtcctaggtcagcccaaggctcgccccctcggtcactctcgtt

SEQ ID NO: 784375 - DNA, 509 bp, Homo sapiens
  misc_feature: HIJSMM301D3QIG.41.21.B10.1.454.light.4.raw
tctatactatcacgaccggtgctcgatttagtgtcgtcgcaagagaggggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctagaagatatcgcaacttattactgtcaacaatataacacttattcaggggcattcggccaaagggaccaaggtaggaaattaaacgaactgtggctgcaccatctgttcttcatcttcccgccta

SEQ ID NO: 784376 - DNA, 506 bp, Homo sapiens
  misc_feature: HIJSMM301BIQ3I.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcaactctcaccatcagcagtctccaacctgaagattttgcaacttacacttgtcaacagagtttcagtagtccccggacggttcgtccgaagggaccaagggtaggaacgatacaaacgaactacgtgcgtgcgaccatacctgtcttta

SEQ ID NO: 784377 - DNA, 503 bp, Homo sapiens
  misc_feature: HIJSMM301AIO8Z.3.35.D02.1.454.light.4.raw
agacgcactccacgaccggtgctcgatttagcacacgatagttgggtttggggaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaacgggacgctggggtcccagacagattcagcggcactgggtcagggcactgatttcacactgagaattagcagggtggaggctgaggatgttgggtatttatttctgcatgcaagctacacactggccgtactacttttggcctaggggaccaagctggagatcaaacgaactgtaggctgcaccatctgtt

SEQ ID NO: 784378 - DNA, 511 bp, Homo sapiens
  misc_feature: HIJSMM301ADJOI.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcattttttgaggtcactacgcgaccctcaggggtccctgatcgcttctctggctccaagtctggcaacacggcctccctgaccgtctctggggctccaggctgaggatgaggctgattattactgcagctcatatgcaggcagcagcagtcccccatgtgatcttcgggcggggggaccgaagctgaccgtcctggtcagcccaggctgtccccccg

SEQ ID NO: 784379 - DNA, 512 bp, Homo sapiens
  misc_feature: HIJSMM301A3Q9U.8.42.D09.1.454.light.4.raw
ctcgcgtgtccacgaccggtgctcgatttagacacatacgcagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaacgcccccaaactcatgatttttgaggtcaataagcggccctcagggtccctgatcgcttctcaggctccaagtctggcaacaccggcctccctgaccgtctctgggctccagactgaggatgaggctgattattactgcagctcatattcaggcagcaacagggtattcggcggaggaccagttgaccgtcctaggtcagcccaaggctcgccccctcggtcactctcgttcccaccctcc

SEQ ID NO: 784380 - DNA, 533 bp, Homo sapiens
  misc_feature: HIJSMM301AZYLD.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgtattatttattgttagttcatataacaaccagtgactacgttgggtgttcgggcgggagggaccaggctgaccgtcctaggtcacgcccaaggctcgccccctcggtccactctcgttccccgcct

SEQ ID NO: 784381 - DNA, 496 bp, Homo sapiens
  misc_feature: HIJSMM301A2WIA.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctacggtcacgcccaacggctcgcccccctccggtccactctcgttcccaccctcctcga

SEQ ID NO: 784382 - DNA, 513 bp, Homo sapiens
  misc_feature: HIJSMM301AL7UP.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggttctaatcgcttctctggctccaagtcctggcaacacggcctccctgacaatctctgggctccaggctgaggacgaggctgattactactgctgctcatatgcaggtcgtatctcttatgtcttcggaactgggaccaagggtctaccgtcctaggtctagccaacggcccaacccccactcgtcta

SEQ ID NO: 784383 - DNA, 519 bp, Homo sapiens
  misc_feature: HIJSMM301D6BYP.16.1.A01.1.454.light.4.raw
  modified_base (403)..(403): a, c, t, g, unknown or other
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctcctgaccgtctctggcctccagactgaggacgaggctgattnttactgccactcatatagaagtagtactactcctgtggttttcggcggtagggaccaagctagaccgtccgtaggttcagccctaaggctgccccctcggtcactctgttcccccg

SEQ ID NO: 784384 - DNA, 491 bp, Homo sapiens
  misc_feature: HIJSMM301ED2EA.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggacaagatcaccgtctaggtcagcccaaggccaaccc

SEQ ID NO: 784385 - DNA, 497 bp, Homo sapiens
  misc_feature: HIJSMM301EF4F3.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagccacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaacagcactctctatgtcttcggaactgggaccaaggtcaccgtctaggtcagcccaagg

SEQ ID NO: 784386 - DNA, 527 bp, Homo sapiens
  misc_feature: HIJSMM301DMW48.27.23.C01.1.454.light.4.raw
  modified_base (227)..(227): a, c, t, g, unknown or other
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacgttgggtgttcgggcggagggaccaggctgaccgtcctaggtcagcccaaggctgcccccgtggtccactctcgttcccaccctt

SEQ ID NO: 784387 - DNA, 500 bp, Homo sapiens
  misc_feature: HIJSMM301A6FK0.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgctagtgtattactgtcagcagtatcataggtcaaacaccttcggccaagggacgacgactggagagttaaaggaactagtggctgcaccatctgtcttctactcttccccg

SEQ ID NO: 784388 - DNA, 505 bp, Homo sapiens
  misc_feature: HIJSMM301AGX44.16.86.H09.1.454.light.4.raw
  modified_base (484)..(484): a, c, t, g, unknown or other
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggacaaggctgaccgtccgtacggtnacgcccaaggctgtccccccg

SEQ ID NO: 784389 - DNA, 447 bp, Homo sapiens
  misc_feature: HIJSMM301AQ6D6.47.85.H08.1.454.light.4.raw
  modified_base (378)..(378): a, c, t, g, unknown or other
  modified_base (422)..(422): a, c, t, g, unknown or other
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggacctaagngtaccgtcctaggtcagcccaaggctgccccctcggtcacttcngttcccgccctcctctacgtgagct

SEQ ID NO: 784390 - DNA, 452 bp, Homo sapiens
  misc_feature: HIJSMM301CV2BH.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccgttttcggcgagggaccaagctgaccgtcctaagtcagcccaaggctgccccctcggtcactctgttcccaccctcctccacgagagta

SEQ ID NO: 784391 - DNA, 490 bp, Homo sapiens; identical to SEQ ID NO: 570048
  misc_feature: HIJSMM301CQFLJ.47.55.E11.1.454.light.4.raw

SEQ ID NO: 784392 - DNA, 515 bp, Homo sapiens
  misc_feature: HIJSMM301A2LHR.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgctagtttattactgtcaacatcgtaccgagtcggccgtccgggggccactttccggcccgtgggaccgaaagtggatatacaaacgaactagtggctcgcaccatctgttctt

SEQ ID NO: 784393 - DNA, 489 bp, Homo sapiens
  misc_feature: HIJSMM301AVDDH.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcactctcaccatcagcagactggagcctgaagattttgcagtctattactgtcagcagtatggtcacgtcccaagaacttttggccgaggggaccaagctggagatacaaacgaactgtggctgcaccat

SEQ ID NO: 784394 - DNA, 488 bp, Homo sapiens; identical to SEQ ID NO: 539612
  misc_feature: HIJSMM301EG0GW.3.55.E11.1.454.light.4.raw

SEQ ID NO: 784395 - DNA, 496 bp, Homo sapiens
  misc_feature: HIJSMM301EQABI.18.59.F04.1.454.light.4.raw
  modified_base (430)..(430): a, c, t, g, unknown or other
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctgtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggtctgattattactgcagctcatanacaagcaccagcactctctatgtcttcggaactggaccaaggtcaccgtcctaggtcagcccaagg

SEQ ID NO: 784396 - DNA, 496 bp, Homo sapiens
  misc_feature: HIJSMM301DR2IN.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctcgaagattttgctagtttattactgtcagcagcgtagcaactggcctctcacccttcggcggagggaccaaggtgggagagtcaaacgaactgtggctgcaccatctgtt

SEQ ID NO: 784397 - DNA, 513 bp, Homo sapiens
  misc_feature: HIJSMM301D7UIO.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggacagggtcaccgtcctaggtcagcccaaggccaacccgactgtcactctcgttcccaccct

SEQ ID NO: 784398 - DNA, 514 bp, Homo sapiens
  misc_feature: HIJSMM301D0P4E.3.37.D04.1.454.light.4.raw
agacgcactccacgaccggtgctcgatttagtagcatactgttgggtttgggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagccccaaactgatgatttatgatgtcaataatcggccctcaggggtttctaatcgtcttctctggctccaagtctggcaacacggcctccctgaccatctctgggctccgagggtgaggacgaggctgattattactgcagctcatttacaagcagcaccactcaggtcttcggaactgggactaaggtcaccgttcctaggtcaggcccaaggccaaccccactcgtcactt

SEQ ID NO: 784399 - DNA, 497 bp, Homo sapiens
  misc_feature: HIJSMM301CD9FV.18.78.H01.1.454.light.4.raw
  modified_base (380)..(380): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatcnctgggctccaggctgaggacgaggctgattattactgcagctcatatacaagcagcagcactcaagtctcggaactgggaccaaggtcacgtcctaggtcagcccaaggcccaaccc

SEQ ID NO: 784400 - DNA, 499 bp, Homo sapiens
  misc_feature: HIJSMM301CI4O4.49.82.H05.1.454.light.4.raw
agtcgagagacacgaccggtgctcgatttagtcgagctctctcgcgggcacgaccggtgctcgatttagtgtcacacgaaggggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagttttattactgtcagcagcgtagcaactggccctctcactttcggcggagggaccaaggtgg

SEQ ID NO: 784401 - DNA, 499 bp, Homo sapiens; identical to SEQ ID NO: 550492
  misc_feature: HIJSMM301EWMOR.43.66.F11.1.454.light.4.raw

SEQ ID NO: 784402 - DNA, 517 bp, Homo sapiens
  misc_feature: HIJSMM301AQBUU.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggcccccccgactcctcatctatagaaatgatcatcggcccctccggggtccctgaccgattctctggctccatgtctggcacctcagcctccctgaccatcagtgggcctccggtccgaggatgaggctgattattactgtgcaccggtgggatgacatcctgaatggtccggtgttcggcggagggaccaggctgacccgtcctaacgtcagcccaaggcctcgccccctc

SEQ ID NO: 784403 - DNA, 516 bp, Homo sapiens
  misc_feature: HIJSMM301AL2SC.43.59.F04.1.454.light.4.raw
tgtgagtagtcacgaccggtgctcgatttagtacacacacttagggattgggggggggtctcaggaggcagcgctctcgggacgtctccaccatggcctgggctctgctattcctcaccctcctcactcagggcacagggtcctgggctcagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctcaagtctggcaacacggcctcctgaccatctctgggctccaggctgaggacgaggctgattattactgcaactcacttacaacgaccgacacttgcgtattcggcggcgggaccaagctcgaccgtcctaggtcagcccaaggcctcgccccctcggtcactcttccg

SEQ ID NO: 784404 - DNA, 501 bp, Homo sapiens
  misc_feature: HIJSMM301DP89X.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacaggacttcactctcaccatcagcagactggagtctgaagattttgcagtgtattattgtcagcaatatggtaggtcacctgggacttttggccaggggaccaagctggaggatcaaacgaaactgtggctgcacccatcttgtcttt

SEQ ID NO: 784405 - DNA, 488 bp, Homo sapiens
  misc_feature: HIJSMM301BTWZY.48.61.F06.1.454.light.4.raw
agtatacatacacgaccggtgctcgatttagctacgctctaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcgaccatcagcagcctgcagtctgaagactttgctagtttattactgtcagcagtatgataactggtcctccgttcaccttcggcggcgggaccaaggtgagatcaaacgactgtggctgcacat

SEQ ID NO: 784406 - DNA, 504 bp, Homo sapiens
  misc_feature: HIJSMM301CF2L8.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtctcatcttcccgca

SEQ ID NO: 784407 - DNA, 448 bp, Homo sapiens
  misc_feature: HIJSMM301AOERV.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaaagcccccaaactcataatttatgacgtcaatgttcgcccctcaggggtttctcatcgcttctctggctccaaatctgacaacacggcctccctgaccatctctgggctcgagtctgaggacgaggctgattacttctgttgctcttgggcaactactgtcgtttggggtgtttcggcggagggaccaagtttgaccgtcctaggtcagcccaaggctgccccctcggtcactctgttcccaccctcctctcgtgagct

SEQ ID NO: 784408 - DNA, 519 bp, Homo sapiens
  misc_feature: HIJSMM301AL1L4.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggactcgaccccccaacccttccgggtaccacgggggacaccggaacgtcggtaggaagttaaaaccgaaacgtgtgggctgccaccatcttcg

SEQ ID NO: 784409 - DNA, 509 bp, Homo sapiens
  misc_feature: HIJSMM301BK3WY.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctagacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcaactactgttcgtttgggtggttcggcggagggaccaagttgaccgtcctaggtcagccaaggcctcgccccctcggtccactct

SEQ ID NO: 784410 - DNA, 521 bp, Homo sapiens; identical to SEQ ID NO: 623133
  misc_feature: HIJSMM301DR4UC.27.23.C01.1.454.light.4.raw

SEQ ID NO: 784411 - DNA, 510 bp, Homo sapiens
  misc_feature: HIJSMM301EKMNL.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacggaggctgactactactgctcagcctgggacaccagcctcgctgcttggccttttcggcggagggaccaagctcgaccgtcctggtcgagcccaaggctcgccccctcggtccta

SEQ ID NO: 784412 - DNA, 511 bp, Homo sapiens
  misc_feature: HIJSMM301AEHPP.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctacgtggtatttgggtggtagggaccaagctgaccgtcctaggtcagcccaaggcctgccccctcggt

SEQ ID NO: 784413 - DNA, 492 bp, Homo sapiens
  misc_feature: HIJSMM301AE4MB.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtccccagacagattcagcggcagtgggtcagacactgatttcacactgaaaatcagcagggtggaggctgaggatgtcggggtttactactgcatgcagggtacactctggccgttcacttttggccaggggaccgaaactggatatcagacgaactgtggctgca

SEQ ID NO: 784414 - DNA, 519 bp, Homo sapiens
  misc_feature: HIJSMM301EADDS.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttatgactatgtctcctggtaccaacaatacccaggcaaacgcccccaaactcatcatttatgatgtcagtaatcggccctcaggggtttctaatcgcttctctggctcaagtctgcaacacggcctcctgacatctctgggctccaggctgatgacgaggctgattattactgcaggtcatatacaatcagacaacacttatgttcttacgggactgggaccaagaactccaccggtccctaaggtcacgcccaacggacccaacccccgactgtaccta

SEQ ID NO: 784415 - DNA, 505 bp, Homo sapiens
  misc_feature: HIJSMM301EGBBI.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccagggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcggggggtaccaagctggtagatacgaaccgaaactcggtggctggcaccatctgtt

SEQ ID NO: 784416 - DNA, 506 bp, Homo sapiens; identical to SEQ ID NO: 569322
  misc_feature: HIJSMM301CLEUB.18.78.H01.1.454.light.4.raw

SEQ ID NO: 784417 - DNA, 516 bp, Homo sapiens
  misc_feature: HIJSMM301ERAE3.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaagtgttacttttcgggcggagggaccaagctcgaccgtccgtgggtcaggcccaaggcctcgcccccctcggtcctacc

SEQ ID NO: 784418 - DNA, 525 bp, Homo sapiens
  misc_feature: HIJSMM301AGEBJ.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccgggatgaggccgactatactgtcaggtgtggagttttaatagtgatcatcccgggggtattcgggcggagggaccaagggtgaccggtccgtacgttcagccccaaggctgtccccctcggtccactcctcgttcccacccctcctcc

SEQ ID NO: 784419 - DNA, 506 bp, Homo sapiens
  misc_feature: HIJSMM301DDSR1.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagccacccaggcaaacgcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctcgaccgtcctaggtcacgcccaaggcctcgccccctcggtcacctctcgttcccccacctccctcgagtgcgtct

SEQ ID NO: 784420 - DNA, 496 bp, Homo sapiens
  misc_feature: HIJSMM301AGW2A.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggcaatctccaaggcgtcttatttataaggtctctgaccgggactctggggtcccagacagattcagcggcagtgggtcagacactgatttcacactgaaaatcagcagggtggaggctgaggatggtcggggtttactactgcatgcagggtacactctggccgttctacttttcggccaagggggaccaaacctggatatcagaacgaactgtggctgca

SEQ ID NO: 784421 - DNA, 499 bp, Homo sapiens
  misc_feature: HIJSMM301CW6AD.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcaggtgggtctgggacagacttcactctcaccatcagcagcctagagcctgaagtattttgctagtttattactgtcagcagcgtagcaactggcctctcaccttcgggcgggaggaccgaaggtaggaggatacaaacgaacgtgtaggctgcaccatcgt

SEQ ID NO: 784422 - DNA, 498 bp, Homo sapiens
  misc_feature: HIJSMM301DF5I2.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatacagcagtgtagggtgggttttccggtcgggaggggaccgaagcctaggtacccgtaccgtaagtcgacgaccccg

SEQ ID NO: 784423 - DNA, 494 bp, Homo sapiens
  misc_feature: HIJSMM301C2L8X.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtccatcaaggttcagcggcactggatctgggacagaattcactctcaccatcaacagcctgcagcctgatgatttggcaacttactactgccaaccgtatagttacttattcggtcaccttcggccaagggaccacgacgtggagattaaacgaact

SEQ ID NO: 784424 - DNA, 494 bp, Homo sapiens
  misc_feature: HIJSMM301BUGYO.14.55.E11.1.454.light.4.raw
  modified_base (492)..(492): a, c, t, g, unknown or other
cgtctagtaccacgaccggtgctcgatttagcactcgcacgttgggtttgggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggacggagggaccgaaggcggagatcagacgaactgtaggctgcaccatctgtcttnta

SEQ ID NO: 784425 - DNA, 500 bp, Homo sapiens
  misc_feature: HIJSMM301AJ2LU.51.45.E01.1.454.light.4.raw
cgatcgtatacacgaccggtgctcgatttagtgagtcagtaagggaaagggggatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctagcaaactatcaccttcggccaagggacacgactggagaattaaacgaactgtggctgacacacttcg

SEQ ID NO: 784426 - DNA, 445 bp, Homo sapiens
  misc_feature: HIJSMM301DABYI.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaaccggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaacgtgaccgtcctaggtcagcccaaggctcgccccctcggtcactctgttccccaccctcctcatagtataga

SEQ ID NO: 784427 - DNA, 484 bp, Homo sapiens
  misc_feature: HIJSMM301CFZ4B.40.37.D04.1.454.light.4.raw
tctagcgactcacgaccggtgctcgatttagtagcatactgttggggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccggtggaggctgaggagtgttggggtttattacgtgcatgcaaggtttataccttcctcggacttcggcctcggaccagagtggatgtcaacgaact

SEQ ID NO: 784428 - DNA, 477 bp, Homo sapiens
  misc_feature: HIJSMM301BG8YW.3.1.A01.1.454.light.4.raw
  modified_base (445)..(445): a, c, t, g, unknown or other
  modified_base (453)..(453): a, c, t, g, unknown or other
agacgcactccacgaccggtgctcgatttagacgtctcatcaggggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtgatctgggacagagttcactctcaccatcagcagcctgcagcctgacgatgtggcaacttattactgccaacagtatgatagttattggacgttcggccaagggaccaaganaagaatanaaacgaactgtaggctgacaccat

SEQ ID NO: 784429 - DNA, 382 bp, Homo sapiens; identical to SEQ ID NO: 649924
  misc_feature: HIJSMM301DALHN.41.26.C04.1.454.light.4.raw

SEQ ID NO: 784430 - DNA, 507 bp, Homo sapiens
  misc_feature: HIJSMM301CIN7M.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatcccctgagcgcttctctggctccaattctgggaacacggccaccctgaccatcagcgcggtcgaagccggagatgaggccgactattactgtcaggtgtgggacagtaatagtgatcccgagcaggtttcggcggtgggaccaagctgaccgtcctaagtcagcccaaggctcgcccccgtcgtccactc

SEQ ID NO: 784431 - DNA, 492 bp, Homo sapiens
  misc_feature: HIJSMM301AMCRT.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccg

SEQ ID NO: 784432 - DNA, 510 bp, Homo sapiens
  misc_feature: HIJSMM301AJK06.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccgaaggtcaccgtcctgggtcacggcccaacggacccaacccccacctacgtcaccttcc

SEQ ID NO: 784433 - DNA, 495 bp, Homo sapiens
  misc_feature: HIJSMM301BXD3K.12.23.C01.1.454.light.4.raw
atacgacgtacacgaccggtgctcgatttagtacacgtgattagggattggggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcaggtgggtctgggacagagttcactctcaccatcagcagcctgcagtctgaagattttgctagtttattactgtcagcagtataataactggttcctgctcactttcggcgggggaccaaggtggagatcaaacgaactgtggctgcacatctgtt

SEQ ID NO: 784434 - DNA, 506 bp, Homo sapiens
  misc_feature: HIJSMM301DOHHP.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatcttcttatgtcttcggaactgggaccaggtcaccgtcctaggtcagcccaaggcccaaccccactcgtcta

SEQ ID NO: 784435 - DNA, 507 bp, Homo sapiens
  misc_feature: HIJSMM301E1QWS.8.28.C06.1.454.light.4.raw
  modified_base (386)..(386): a, c, t, g, unknown or other
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatcngacgactttgcagtttattctgtcagcagtctgaagactggccgttcactttcggcggtagggaccaaggttggacctcaaacggactagtggctgcaccatcgtgtcttcatcttcccgc

SEQ ID NO: 784436 - DNA, 494 bp, Homo sapiens
  misc_feature: HIJSMM301EWDE0.26.78.H01.1.454.light.4.raw
  modified_base (478)..(478): a, c, t, g, unknown or other
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctactactttcggcggaggggaccagggtggagatcagacgaactgnggctgcaccatctgtt

SEQ ID NO: 784437 - DNA, 489 bp, Homo sapiens
  misc_feature: HIJSMM301C5PLJ.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccatccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtgcagtgggtctgggacagagttcacttctcaccatcagcagcctgcagtctgaggattttgctagtttattactgtcagcattacaataactggcctcggctcactttcggcggagggaccgaaggtggagatacaaacgaactgtagctgcaccat

SEQ ID NO: 784438 - DNA, 515 bp, Homo sapiens
  misc_feature: HIJSMM301AUUUM.9.55.E11.1.454.light.4.raw
  modified_base (432)..(432): a, c, t, g, unknown or other
  modified_base (435)..(435): a, c, t, g, unknown or other
tgatacgtctcacgaccggtgctcgatttagcactcgcacgttgggtttgggggctgggcctaaggaagcagcactggtggtgcctcagccatggcctggaccgttctcctcctcggcctcctctctcactgcacaggctctgtgacctcctatgtgctgactcagccaccctcggtgtcagtggcccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtggtgggctggtgataangancatggcgggggtgtcgggcggagggaccaagctgaccgtccgtaagtcgagccgaaggctcgccccctcggtcactctcg

SEQ ID NO: 784439 - DNA, 492 bp, Homo sapiens
  misc_feature: HIJSMM301AU6R1.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctcggggtccctgagcgattctccggctccggctctgggaacacagtcactctgaccatcagcggacccaggctattgatgaggctgtctacttctgtcaggcgtgggacaacagcgtggtgttcggcggaggaccagtctgaccgtcttaggtcagcccaaggctgccccctcggtccactccg

SEQ ID NO: 784440 - DNA, 499 bp, Homo sapiens
  misc_feature: HIJSMM301BTL9C.10.65.F10.1.454.light.4.raw
  modified_base (357)..(357): a, c, t, g, unknown or other
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttacnctcaccatcagcgatctgcagcctgacgattttgcgacttactactgtcaacagagtttccggaaccccgttactttcggcggagggaccaaggtggagatcaaacgaactgtggctgcaccatctgtcttcatcttccccg

SEQ ID NO: 784441 - DNA, 514 bp, Homo sapiens
  misc_feature: HIJSMM301B9ZCT.13.23.C01.1.454.light.4.raw
  modified_base (460)..(460): a, c, t, g, unknown or other
tcacgtactacacgaccggtgctcgatttagtacacgtgattagggattggggcagcttcggctgtgggtagagaagacaggactcaggacaatctccagcatggccagcttccctctcctcctcaccctccccactcactgtgcagggtcctgggcccagtctgtgctgactcagccaccctcagcgtctgggacccccgggcagagggtcaccatctcttgttctgaaagcagctccaacaccggaactggtgatataaactggtaccagcagctcccaggacggcccccaaactcctcatctatactaatatcaccggccctcagggatccctgaccgattctctgcctccaagtctggcacctcagcctccctggccatcagtcggctccagtctgaggatgaggctgattattactgtgcagcatactatgacaccctgaatggtctttggggtnttcggcggtaggggaccaaggctggaccgtcctaggtctagcccaaggctcccg

SEQ ID NO: 784442 - DNA, 510 bp, Homo sapiens
  misc_feature: HIJSMM301EB445.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagctgaggacgaggctgattatactgccactcatatagaagtagtactactcctgttggttttcggcgggagggaccaagctgaccgtcctaggtcagcccaaggctgccccctcggtcactctcgtt

SEQ ID NO: 784443 - DNA, 447 bp, Homo sapiens; identical to SEQ ID NO: 535201
  misc_feature: HIJSMM301AI6D8.18.9.A09.1.454.light.4.raw

SEQ ID NO: 784444 - DNA, 491 bp, Homo sapiens
  misc_feature: HIJSMM301DX9W9.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttaccagtacccccctcacctttcggcggagggaccaaggcggagatcagacgaactgtggctgcaccatctgttctcta

SEQ ID NO: 784445 - DNA, 496 bp, Homo sapiens
  misc_feature: HIJSMM301BJUWM.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcaggggaaaccccctaagctcctgatctatggtgcatccactttggaaagtggggtcccctcaaggttcagcggcagtggatctgggacagatttcactctcgccatcagcagcctgcagactgaagattttgactaacttatttttgtcaacaggctaacctactttccccctcactttcggcggagggaccaaggtggagatcaagcgaactgtggctgcaccatctgtctt

SEQ ID NO: 784446 - DNA, 512 bp, Homo sapiens
  misc_feature: HIJSMM301EW5O0.5.24.C02.1.454.light.4.raw
  modified_base (342)..(342): a, c, t, g, unknown or other
atcagacacgcacgaccggtgctcgatttagtacagatcgttaggggaaaggggggggtctcaggaggcagcgctctcaggaagtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttcnctggctccaagtctggcaacacggcctccctgaccgtctctgggctccaggctgaggatgaggctgattattactgcagctcatatgcaggcaggcagcagtccccatcgtgatcttcggcggggggaccaaggctgaccgtcctaggtcagcccaaggctgtccccccg

SEQ ID NO: 784447 - DNA, 518 bp, Homo sapiens
  misc_feature: HIJSMM301EUYOV.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagctaggtttcggtcggtgggaccaagctgaccgtcctaagtcagccaacggctcgccccctcggtcactctcgttcccccg

SEQ ID NO: 784448 - DNA, 500 bp, Homo sapiens
  misc_feature: HIJSMM301D9H65.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgctagtttattactgtcagcagcgtagcaactggcctttcactttcggccggggaccaagtaggaaatacaaacgaactgtgctgcaccatctgtcttcatcttcccgccat

SEQ ID NO: 784449 - DNA, 504 bp, Homo sapiens
  misc_feature: HIJSMM301BBNTT.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcgggggtcagagtttcactctcaccatcagcagcctgtagtctgaagattttgcagtttattactgttcagcagtatgatacctggcctccgtacaccttttggccgggggaccaagctggaaatcaagcgaactgtggctgcaccatctgtcttcatcttccccg

SEQ ID NO: 784450 - DNA, 490 bp, Homo sapiens
  misc_feature: HIJSMM301EHFTY.17.35.D02.1.454.light.4.raw
cgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgctaattattactgtaccaacagtatcatcatcattgtaatttcggtggaggaccaaggtggaggtcaaacgaactgtaggctgcaccatctgtctt

SEQ ID NO: 784451 - DNA, 509 bp, Homo sapiens
  misc_feature: HIJSMM301CWOVM.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatggaggctgattattactgcagctcatatgcaggcagcagcaatgtacttttcggcggaggaccaagctgaccgtccgtgggtcagcccaaggcctgcccccgtcggtctacc

SEQ ID NO: 784452 - DNA, 523 bp, Homo sapiens
  misc_feature: HIJSMM301DKXRH.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctcggggtcccagacagattcagcggcagtgggtcaggcactgatttcacactggaaatcagcgagggtggaggctgaggagtgttggggtttattactgcatgacaaactacacgacggccgctctactttcggcggtacgggaccgaaggtaggagaataccaaaacgtaactggtggctgccaccatctgtt

SEQ ID NO: 784453 - DNA, 511 bp, Homo sapiens
  misc_feature: HIJSMM301AE9JK.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgctagctcatatgcagcagcagcacgtccccatgtgatcttcgggtcggggggaccaagcctgaccgtccaggtcagcccaaggctgtccccccg

SEQ ID NO: 784454 - DNA, 507 bp, Homo sapiens
  misc_feature: HIJSMM301DMC42.26.23.C01.1.454.light.4.raw
  modified_base (488)..(488): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatattattctccagcgttcggtcccaggggtacccaagggttgggaaagttcaagacggaacctgtcggntgacacccaatcctggtta

SEQ ID NO: 784455 - DNA, 505 bp, Homo sapiens
  misc_feature: HIJSMM301DIA4W.2.35.D02.1.454.light.4.raw
  modified_base (492)..(492): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggccttaggggtccctgatcgcttctctggctccaagtctggcagaacggcctcctgaccgtctctgggctccaagctgaggatgaggctgattattactgcagctcatatgcaggcaggcagctaatgtaacttttcggcggagggaccaaagctgaccgtctgggtcaagcccaaggcngccccctggtcaa

SEQ ID NO: 784456 - DNA, 489 bp, Homo sapiens
  misc_feature: HIJSMM301AMWTD.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagttttattactgcatgcaagctctacaaactcctctcactttcggcggagggaccaaggtggagatacaaacgaactgt

SEQ ID NO: 784457 - DNA, 536 bp, Homo sapiens
  misc_feature: HIJSMM301BKTAK.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccatttttatattgacacagccccactctgtgtcggagtcttcgggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattaggcgggagggaccggagggtggtacccgtccgtacggtacacgcccgaaggctgccccctcggtccactcctgttccccgt

SEQ ID NO: 784458 - DNA, 494 bp, Homo sapiens; identical to SEQ ID NO: 769832
  misc_feature: HIJSMM301EJGUC.10.72.G06.1.454.light.4.raw

SEQ ID NO: 784459 - DNA, 501 bp, Homo sapiens
  misc_feature: HIJSMM301AL5A3.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacgtttatttttgctgctcttatgcaggcagtttcgctctcgaagtgtcggcggagggaccgagctgaccgtcctacgtcagcccaaggctccgg

SEQ ID NO: 784460 - DNA, 518 bp, Homo sapiens
  misc_feature: HIJSMM301D2G60.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctcgttcccacccttcttccc

SEQ ID NO: 784461 - DNA, 517 bp, Homo sapiens
  misc_feature: HIJSMM301AWN0C.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgtttcgggactgggaccaaggtcaccgtcctaggtccagcccaaggcccaaccccactgtcactcttccg

SEQ ID NO: 784462 - DNA, 547 bp, Homo sapiens
  misc_feature: HIJSMM301CB49U.3.33.C11.1.454.light.4.raw
  modified_base (303)..(303): a, c, t, g, unknown or other
agacgcactccacgaccggtgctcgatttagagtgagctcgttgggtttgggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttangaggtcacaaagcggccctcaggggtccctgatcgcttctctgcctccaagtctggcaacacggcctccctgaccgtctctgggctccagcctgaggatgaggctgattattactgctagctcatatgcaggccatccaactacttggtttttccgggcgggtaacgggacccgaaaggtccgtacggacccgttaccttacgggtccaacggtacccccgaaagggtcctccggtcccccccc

SEQ ID NO: 784463 - DNA, 521 bp, Homo sapiens
  misc_feature: HIJSMM301A983M.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtccctttcggtttctggctccatcgacagtccctccaactccgcctcccttaccatatctgggctgaagagtgaggacgaggctgactacttctgtcagtcttatgatataaacaattaatgtgtataattggcggtagggaccgagggtgaccgtcctaggtcagccaaggctgccccctcggtcacgtctgttcccta

SEQ ID NO: 784464 - DNA, 492 bp, Homo sapiens; identical to SEQ ID NO: 538644
  misc_feature: HIJSMM301BODPX.26.78.H01.1.454.light.4.raw

SEQ ID NO: 784465 - DNA, 501 bp, Homo sapiens
  misc_feature: HIJSMM301CMNWN.52.6.A06.1.454.light.4.raw
cgcagtacgacacgaccggtgctcgatttagatctactgacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgaggtcagtgatcggccgcaggggtttctcatcgcttctccggctccaagtctggcagcacgcctccctgaccatctctgggctccaggctgaggacgaggctgattattactgcagctcatatacaagcagaacacttggtgttcggcggcgggaccaactgaccgtcctacgtcagcccaaggctgccccctcggtcacgtt

SEQ ID NO: 784466 - DNA, 503 bp, Homo sapiens
  misc_feature: HIJSMM301AM30Y.48.67.G01.1.454.light.4.raw
agtatacatacacgaccggtgctcgatttagagtatacatattgggtttgggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaagggtggacatcaaacgaactgtggctgcaccatctgtcttcatccttcccg

SEQ ID NO: 784467 - DNA, 489 bp, Homo sapiens
  misc_feature: HIJSMM301A42M2.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaaacaaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatcttttatgtcttcggatcgtggaccagggtcaaccgtcctagtcagcccaaggccaaccca

SEQ ID NO: 784468 - DNA, 488 bp, Homo sapiens
  misc_feature: HIJSMM301DNYE1.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggcctaggggaccaagctggagatacaaacgaactagtggctagcacc

SEQ ID NO: 784469 - DNA, 512 bp, Homo sapiens
  misc_feature: HIJSMM301BUXJJ.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaacttcgttgggttgttcggcggagggaccaagctgacccgtctaggtcagcccaaggctcgccccctcggtccactcttccg

SEQ ID NO: 784470 - DNA, 511 bp, Homo sapiens
  misc_feature: HIJSMM301EA4YC.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctggggctcgagtctgagggacgaggctgatttacttctgttgctcttggcaactactgtcgtttgggtgttcggcggagggaccaagttgaccgtcctaggtcagcccaggctgccccctcggtcactctcgtt

SEQ ID NO: 784471 - DNA, 509 bp, Homo sapiens
  misc_feature: HIJSMM301BFXJB.27.78.H01.1.454.light.4.raw
agcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatacagtagtactaccttttacctcaagtgatcaccttcggccaagggacacgactcggagattaaacg

SEQ ID NO: 784472 - DNA, 531 bp, Homo sapiens
  misc_feature: HIJSMM301CFRO1.48.61.F06.1.454.light.4.raw
agtatacatacacgaccggtgctcgatttagctacgctctaagggaaagggggcgtgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaagtgtgcactggtaccagcagaagccaggccaggcccctgtgctggtcgtctttgatgataccgaccggccctcagggatccctgagcgattctctggcttccaactcgtgtgaacacggccaccctgaccatcagcagggtcgaagccggggatgaggccgactattactgtcaggtgtgggatagtagtagtgatcatcctaattgggtgttcggacggtagggaccaagctgaccgtcctaggtctagcccgaaggcctggccccctcggtccactctcgttcccgccctt

SEQ ID NO: 784473 - DNA, 525 bp, Homo sapiens
  misc_feature: HIJSMM301DPPDT.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgcgtggcgtctggctggttcggcggagggaccaagctgaccgtcctaggtcagcccaaggctcgccccctcggtcactctcgttccccaccctcctcacgtcg

SEQ ID NO: 784474 - DNA, 502 bp, Homo sapiens
  misc_feature: HIJSMM301AO6UY.51.81.H04.1.454.light.4.raw
  modified_base (405)..(405): a, c, t, g, unknown or other
cgatcgtatacacgaccggtgctcgatttagtagtgtagattcgcggggtgtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtnaatcaacagacaccattggtacttatgttcttcggaactgcgaccaaggtcaccgtctcgggtcacgacccaggacccaaccccactcgtcacttcc

SEQ ID NO: 784475 - DNA, 492 bp, Homo sapiens
  misc_feature: HIJSMM301A4Y5S.9.1.A01.1.454.light.4.raw
  modified_base (401)..(401): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattacngtcagcagtatcataggtcaaacaccttcggccaagggacacgactggagattaaagaactgtggctgcaccatctgtcttcatcttcccg

SEQ ID NO: 784476 - DNA, 357 bp, Homo sapiens
  misc_feature: HIJSMM301B2Q79.19.22.B11.1.454.light.4.raw
tactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactccaataataagaactacttagcttggttccagcagaaaccaggacagcctcctaagatgcttcttttattgggcatctgcccgggaatccggggtccctgaccgattcagtggcaggcgggtctgggacagtatttcactctcacca

SEQ ID NO: 784477 - DNA, 521 bp, Homo sapiens
  misc_feature: HIJSMM301CPZ2S.43.23.C01.1.454.light.4.raw
  modified_base (504)..(504): a, c, t, g, unknown or other
tgtgagtagtcacgaccggtgctcgatttagtacacgtgattagggattggggtctggcgccaggggtccctaccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgccttgctcatatatggtggcgcgtgggtgttcggcggagggaccaagctgaccgtcctgggtcagccctaaggctggcccccctcggtaccnctctggttcccgccctt

SEQ ID NO: 784478 - DNA, 483 bp, Homo sapiens
  misc_feature: HIJSMM301CUW4S.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccagggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcgggagggaccgaagctagaccgtcctaagtcagccccg

SEQ ID NO: 784479 - DNA, 510 bp, Homo sapiens
  misc_feature: HIJSMM301BQL5Z.48.38.D05.1.454.light.4.raw
agtatacatacacgaccggtgctcgatttagtatctgatagttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggcccctgtgctggtcatctttgaggacaacaaacgaccctccgggatccctgagagattctctggctccagctccagggacaatggccaccttgactatcaatggggcccaggtggacgatgaggctgactactactgttcctcaacagacagtagtggtgatcgagggctggttcggcggagggaccgaagctgaccgtcctaagtcagcccaaggctcgccccctcggtcactcttccg

SEQ ID NO: 784480 - DNA, 505 bp, Homo sapiens
  misc_feature: HIJSMM301EVKE5.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatccaaggttcagcggcagtggatctgggacagaattcactctcactatcaccagccctgcaacctcgatgattttgcaacttattactgccaacagtatcatcatcattgtaattttcggttggagggaccaagggtggagggtctaaacgaaactagtggctggcaccgaatctagtcttcatt

SEQ ID NO: 784481 - DNA, 536 bp, Homo sapiens
  misc_feature: HIJSMM301BGAOY.27.23.C01.1.454.light.4.raw
agcgtcgtctcacgaccggtgctcgatttagtacacgtgattagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcgggtagggaccagggctgacccgtccttagggtcagcccaaggctcgccccctcggtccactctcgttcccgccctccc

SEQ ID NO: 784482 - DNA, 507 bp, Homo sapiens
  misc_feature: HIJSMM301EA4K7.19.78.H01.1.454.light.4.raw
tactctcgtgcacgaccggtgctcgatttagtgtgagtagtttgggtttggggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcgaggggtttctaatcgcttctctggctcaagtctggcaacacggcctccctgacaatctctgggctccaggctgaggacgaggctgattactactgctgctcaatatgcaggtcgtatcttcttatgtcgttcggactgggaccaggtcaccgtcctggtcagccaaggccaacccactcgtcta

SEQ ID NO: 784483 - DNA, 500 bp, Homo sapiens
  misc_feature: HIJSMM301ATL3C.48.86.H09.1.454.light.4.raw
agtatacatacacgaccggtgctcgatttagtgctatagacttgggtttggggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattacctcggacgttcggccgaagggaccaacggtaggaacggtcgaaaccgaaactacggtggtccgtgcgacctaa

SEQ ID NO: 784484 - DNA, 512 bp, Homo sapiens
  misc_feature: HIJSMM301E048T.43.59.F04.1.454.light.4.raw
tgtgagtagtcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaagccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgtt

SEQ ID NO: 784485 - DNA, 499 bp, Homo sapiens
  misc_feature: HIJSMM301EGOJH.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaattcttcagacatcagtggttacttatgtcttcggaactggaccaaggtcaccgtcctaggtcagcccaaggcccaacccctactcgtcactcttccg

SEQ ID NO: 784486 - DNA, 501 bp, Homo sapiens
  misc_feature: HIJSMM301A1AKH.52.55.E11.1.454.light.4.raw
cgcagtacgacacgaccggtgctcgatttagcactcgcacgttgggtttggggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagtattttgctagtttattactgtcagcagcgtagccactggctctctttcggcggagggaccaaggttgagatcaaacgaactgtggctgcaccatctgtcttcactcttcccg

SEQ ID NO: 784487 - DNA, 506 bp, Homo sapiens; identical to SEQ ID NO: 543993
  misc_feature: HIJSMM301D2G9E.18.78.H01.1.454.light.4.raw

SEQ ID NO: 784488 - DNA, 480 bp, Homo sapiens
  misc_feature: HIJSMM301C9MWO.48.62.F07.1.454.light.4.raw
  modified_base (414)..(414): a, c, t, g, unknown or other
agtatacatacacgaccggtgctcgatttagtagtcgcataaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaatcatgatttatgatgtcactaagccggccctcaggggtccctgctcgcttctctggctccaagtctggcaacacggcctccctgaccatctctgggctccaggctgaagatgaggctgattnttctgctgctcatatgcagccaactattatgtcttcggaactgaagtaccaaggtccaaccgtcct

SEQ ID NO: 784489 - DNA, 497 bp, Homo sapiens
  misc_feature: HIJSMM301B608D.46.35.D02.1.454.light.4.raw
  modified_base (206)..(206): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctntcctgcagggccagtcactatgttagtgacaactacttagcctgggttgcagcacaaacctggccaggctcccaggctcctcatctatgctgcatccatcagggccactggcatcccaggcagattcagtggcagtgggtctgggacagacttcactctcaccatcagcagactggagcctgaagattttgctagtctattactgtctagcagtatggtcacgtcccaagtaacgttttggccgaggggaccaagctggagatacaaacgaactgtggctgcacatcttcg

SEQ ID NO: 784490 - DNA, 505 bp, Homo sapiens
  misc_feature: HIJSMM301D7F29.52.37.D04.1.454.light.4.raw
cgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacaagaacacttgggtgttcggcggcgggaccaactgaccgtcctacgtcagccaagctgccccctcggtc

SEQ ID NO: 784491 - DNA, 500 bp, Homo sapiens
  misc_feature: HIJSMM301AHJNM.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatggaggctgactattactgtcaggcggtaggacagcagcactgaggtgttcggcggagggaccaaggctcgaccgtccctaacgtcacgcccaagggcctacgtccccccg

SEQ ID NO: 784492 - DNA, 501 bp, Homo sapiens; identical to SEQ ID NO: 676894
  misc_feature: HIJSMM301EW6YC.47.66.F11.1.454.light.4.raw

SEQ ID NO: 784493 - DNA, 495 bp, Homo sapiens
  misc_feature: HIJSMM301DA5ZL.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagtattttacactagaaaatcagcagagtggaggctgaggatggttggggtttattactgcatgcaagctctacaaactccttacacttttggccaggggaccaagctggagatacaaacgaactgt

SEQ ID NO: 784494 - DNA, 492 bp, Homo sapiens
  misc_feature: HIJSMM301BXAO1.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactgacatcccagacaggttcagtggcaggtgggtctgggacagacttcactctcaccatcagcagactggagcctgaggattttgcagtgtattactgtcagcagtatcataggtcaaacaccttcggccaagggacacgactggagattaaaggaactgtgctgcacatctgtcttcactctcccg

SEQ ID NO: 784495 - DNA, 497 bp, Homo sapiens
  misc_feature: HIJSMM301AWDYM.51.37.D04.1.454.light.4.raw
  modified_base (471)..(471): a, c, t, g, unknown or other
cgatcgtatacacgaccggtgctcgatttagtagcatactgttgggtttgggggtggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgttcttcggaactgcgaccaaggtcaccgtcctgggtcngcccaaggcccaaccccactgtcact

SEQ ID NO: 784496 - DNA, 505 bp, Homo sapiens
  misc_feature: HIJSMM301B2GUL.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtattactgtcagcagtatcataggtcaaacaccttcggccgaagggacacgactaggaagaattaaaggaactaggtggctgcaccatcttgtcttcattccttcccccg

SEQ ID NO: 784497 - DNA, 514 bp, Homo sapiens
  misc_feature: HIJSMM301EGLHC.5.24.C02.1.454.light.4.raw
  modified_base (249)..(249): a, c, t, g, unknown or other
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaacaccccgacaaagcccccaaactcatcatttttgaggtcactacgcgaccctcaggggtccctgatcgcttctctggctcaagtctggcaacacggcctccctgaccgtctctgggctccaggctgaggatgaggctgattattactgcagctcatatgcaggcagcagcacgtccccatgtgatcgttcgggcggggggaccaaggctgaccgtcctaggtcacgcccgaaggctcgtccccccg

SEQ ID NO: 784498 - DNA, 517 bp, Homo sapiens
  misc_feature: HIJSMM301D7OQQ.17.33.C11.1.454.light.4.raw
  modified_base (471)..(471): a, c, t, g, unknown or other
cgtagactagcacgaccggtgctcgatttagagtgagctcgttgggtttgggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctcttggggcaaagctgccctgacactgtctggtgtgcagcctgaggacgaggctgactattactgcctactctactttggtggtgctgtgctgttcggtcggagggaccaaggcctagaccgtnttaagtcaggcccaaggctcgccccctcggtcactctcgttcccgt

SEQ ID NO: 784499 - DNA, 509 bp, Homo sapiens
  misc_feature: HIJSMM301DIOB0.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctctatatgcaggcagttacaatgtgatagtttcggcgggtagggaaccgaaaactggaaccgtccgtaggtaccagcccaaggcct

SEQ ID NO: 784500 - DNA, 502 bp, Homo sapiens
  misc_feature: HIJSMM301BXGPA.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcaggtggatctgggacacatttcaccctcaccatcaatagcctggaagctgaagatgctgcaacttattactgtcatcagagtactacttactcaagtgatcaccttcggcccaagggaccacgacctggagagttaaacgaactcgtggcctgcaccatctagtccttt

SEQ ID NO: 784501 - DNA, 508 bp, Homo sapiens
  misc_feature: HIJSMM301BPE7M.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgtctccgttacacttttggcctacggggacccgaggtggaggatcgagacgtaacgtgtggctcgcaccattctgtcttcatccttcccgt

SEQ ID NO: 784502 - DNA, 556 bp, Homo sapiens
  misc_feature: HIJSMM301BGE9V.5.27.C05.1.454.light.4.raw
atcagacacgcacgaccggtgctcgatttagacgcgatcgaagggtttgggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggccccctgtactggtcatctattatgataccgaccggccctcagggatccctgagcgattctctggctccaagtctgggaacacggccaccctgaccatcagcagggtcgaagccggggatgaggccgactattactagtcaggtgtggaatggtgattatgattatgtcttcggtaacgtgggaccgaaggtcacccggtcctacggttcgagcccgaacgggaccgaacccccaacctcggtcctacgtacctcgttccccacccctcccttcccgtcgttccg

SEQ ID NO: 784503 - DNA, 383 bp, Homo sapiens; identical to SEQ ID NO: 447524
  misc_feature: HIJSMM301BNVO4.41.26.C04.1.454.light.4.raw

SEQ ID NO: 784504 - DNA, 517 bp, Homo sapiens
  misc_feature: HIJSMM301D8V5H.43.23.C01.1.454.light.4.raw
tgtgagtagtcacgaccggtgctcgatttagtacacgtgattagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggtttcaggctccctccttgggggcaaagctgccctgacactgtcaggtgtgcaccctgaggacgaggctgagtattactgtctgctcctactttcgtactgcctgggtcttcggcgggggactcgagttgaccgtcctaggtcagccaggctgccccctcggtcactctgttccaccctcctcactact

SEQ ID NO: 784505 - DNA, 513 bp, Homo sapiens; identical to SEQ ID NO: 642500
  misc_feature: HIJSMM301ENFYD.8.33.C11.1.454.light.4.raw

SEQ ID NO: 784506 - DNA, 519 bp, Homo sapiens
  misc_feature: HIJSMM301EZNLA.9.53.E09.1.454.light.4.raw
  modified_base (479)..(479): a, c, t, g, unknown or other
tgatacgtctcacgaccggtgctcgatttagagagagtgtggttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggacaaagcccccaaactcatcatttatgaggtcactaagcggccctcaggggtttctattcgcttctctggctccaagtctgacaacacggcctccctgacatctctgggctccaggctgaggacgaggctgattattactgctgctcatatgcaagatgggtgacactcccgtgggttattcggcgggagggaccaagggtnacccggtcctaaggtcaggccccaaggcctgtcccccccg

SEQ ID NO: 784507 - DNA, 511 bp, Homo sapiens
  misc_feature: HIJSMM301CQTI4.47.52.E08.1.454.light.4.raw
agctcacgtacacgaccggtgctcgatttagtcgagctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctcctgaccatctctgggctcgagtctgaggacgaggctgattacttctgttgctcttgggcaactactgtcgttttggggtgttcggcgggagggaccaagttgaccgtcgtaggtcagcccaaggctgacccccgtcggtcactctcgttcccaccctcctctaccgtgacgctctcga

SEQ ID NO: 784508 - DNA, 488 bp, Homo sapiens
  misc_feature: HIJSMM301AI5V3.10.72.G06.1.454.light.4.raw
catagtagtgcacgaccggtgctcgatttagctacgactgcaaggggaaagggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctgcaacacggcttccctgaccatctccgggctccacgctgaggacgaggctcattattactgcagctcatatacacccaggggcactctcgtgatattcgggcggagggacctggctgacccgtcctacgtc

SEQ ID NO: 784509 - DNA, 513 bp, Homo sapiens
  misc_feature: HIJSMM301AY334.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccgggatgaggccgactattactgtcaggtgtgggatagtagtggtgatcatccatacgtcttcgaactgggaccaaggtctccgtcctacgtccagcccaaggcccaacccccactcgtcactctcgttcccgt

SEQ ID NO: 784510 - DNA, 497 bp, Homo sapiens
  misc_feature: HIJSMM301BWXFJ.10.33.C11.1.454.light.4.raw
  modified_base (486)..(486): a, c, t, g, unknown or other
  modified_base (494)..(494): a, c, t, g, unknown or other
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactcttcggcatccgcagcctgcagcctgaagattttgcgacatattactgtcaacagtatgaaaatgtacccgctcactttcggcgggggaccgaaggtggagttacaacgaactagtggctgcacanctgtcttnatt

SEQ ID NO: 784511 - DNA, 490 bp, Homo sapiens
  misc_feature: HIJSMM301AP1KO.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttccggcacggggacaaggtaggaagtcaagcgaactgtggctgcaccatctgtt

SEQ ID NO: 784512 - DNA, 499 bp, Homo sapiens
  misc_feature: HIJSMM301EYPR2.14.55.E11.1.454.light.4.raw
  modified_base (83)..(83): a, c, t, g, unknown or other
  modified_base (156)..(156): a, c, t, g, unknown or other
cgtctagtaccacgaccggtgctcgatttagcactcgcacgttgggtttggggagtctcagtcaggacacagcatggacatgnggtccccgctcagctccgtggggctcctgctactctggctccgaggtgccagatgtgacatccagatcgaccngtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatcgtgggacagactttcactctcaccgtcagcagtctgcaacctgaagtattttgctaacttactactgtcaacagagttaccacgtacccccctctacctttcggcggagggaccgaaggcggagatcagacgaactgtggctgcaccatctgtcttctac

SEQ ID NO: 784513 - DNA, 516 bp, Homo sapiens
  misc_feature: HIJSMM301ELIYE.40.12.B01.1.454.light.4.raw
tctagcgactcacgaccggtgctcgatttagtagtgtagattccgcgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctcgtgggctccaggctgaagatgaggctgattattactgctactcgtatgcaggcggcaaacaattgggtcttcggcggagggaccaagctgaccgtcctaggtcagcccaaggctcgccccctggtccactcttcg

SEQ ID NO: 784514 - DNA, 523 bp, Homo sapiens
  misc_feature: HIJSMM301EI1VF.7.86.H09.1.454.light.4.raw
  modified_base (211)..(211): a, c, t, g, unknown or other
cgtgtctctacacgaccggtgctcgatttagtgctatagacttgggtttgggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctgggggganagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaaacagactgcagcctgaagatattgcagtttactactgtcagcagtatgttacgtccccgtggacgttcggccaaggaccaaggtggacaatcaaccgaactacgtgcctggcaccatctgtcttcatcttccccg

SEQ ID NO: 784515 - DNA, 487 bp, Homo sapiens
  misc_feature: HIJSMM301C5NSX.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgctactttggccaggggaccaaagttagagatcaaacgaactgtggctgcaccatctgtt

SEQ ID NO: 784516 - DNA, 525 bp, Homo sapiens
  misc_feature: HIJSMM301CT61B.19.72.G06.1.454.light.4.raw
tactctcgtgcacgaccggtgctcgatttagctacgactgcaagggaaagggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttataccccttgtctcctggtaccaacaataccccggcaaagccccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcgggagggaccaagggtgacccggtcctggggtcagacccaagggcctcggcccccctcggtccacgtt

SEQ ID NO: 784517 - DNA, 497 bp, Homo sapiens
  misc_feature: HIJSMM301AKI90.43.37.D04.1.454.light.4.raw
  modified_base (205)..(205): a, c, t, g, unknown or other
tgtgagtagtcacgaccggtgctcgatttagtagcatactgttgggtttggggagcttcagctgtgggtagagaagacaggactcaggacaatctccagcatggccagcttccctctcctcctcaccctcctcactcactgtgcagggtcctgggcccagtctgtggtgactcagcccaccctcagcgtctgggaccccccgganagagggtcagcatctcctgttctggaagcagctccaacattggacgtaatactgtaaactggtaccagcaactcgcaggaacggcccccaaactcctcatctatgaccatcatcagcggccctcacggggtccctgaccgattctctggctccaagtctggctcttcacgcctccctggccatcagtgggctccagtctgaggatgaggctgattattactgtgcagcgtgggatgacagcctgaatgcttgggtgttcggcggagggaccgaaggtcgaccgtccgtaggt

SEQ ID NO: 784518 - DNA, 495 bp, Homo sapiens; identical to SEQ ID NO: 584704
  misc_feature: HIJSMM301A8HLO.9.1.A01.1.454.light.4.raw

SEQ ID NO: 784519 - DNA, 362 bp, Homo sapiens
  misc_feature: HIJSMM301DJLYK.3.57.F02.1.454.light.4.raw
agacgcactccacgaccggtgctcgatttagctcgatatagttgggtttggggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctactgtcaacccaaggctggcccctcggtcatctgttctcaccctcctcgagtgcgtct

SEQ ID NO: 784520 - DNA, 485 bp, Homo sapiens; identical to SEQ ID NO: 535749
  misc_feature: HIJSMM301A9TS3.46.35.D02.1.454.light.4.raw

SEQ ID NO: 784521 - DNA, 500 bp, Homo sapiens
  misc_feature: HIJSMM301A2TC1.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttcgtggcctccgctcactttcggcggacgggaccgacgggtggagatcaaacgaactgtggctgcaccatctgtcttcattcc

SEQ ID NO: 784522 - DNA, 532 bp, Homo sapiens
  misc_feature: HIJSMM301DXNAK.12.21.B10.1.454.light.4.raw
atacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacgttgggtgttcggcggcgggaccaaaggtcgaccgtcctaagtcagcccaaggctcgccccctcggtcacctctgttccccacccttccc

SEQ ID NO: 784523 - DNA, 506 bp, Homo sapiens
  misc_feature: HIJSMM301AL8JI.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttcggccctcgggaccaagtggatatcaaacgaactgtggctgcaccatctgtcttcattccc

SEQ ID NO: 784524 - DNA, 506 bp, Homo sapiens
  misc_feature: HIJSMM301A6CPC.49.42.D09.1.454.light.4.raw
  modified_base (489)..(489): a, c, t, g, unknown or other
agtcgagagacacgaccggtgctcgatttagacacatacgcagggaaaggggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacccctctcctgcagggccagtcagagtgttagtagcttcttagcctagtaccaacagaaacctggccaggctcccaggctcctcatctatgatgcatccaacagggccactggcatcccagccaggttcagtggcagtgggtctgtgacagacttcactctcaccatcagcagcctagacgcctagaagattctgctagtttattactgtcagcagcgtaggcaactggcctctctacttcggtcgggagggaccgaggtaggtagatacgaaacaacgtgtggngtgcaccactcttcgtt

SEQ ID NO: 784525 - DNA, 518 bp, Homo sapiens
  misc_feature: HIJSMM301CXIFJ.41.25.C03.1.454.light.4.raw
  modified_base (457)..(457): a, c, t, g, unknown or other
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcgngggaccagggtgaccgtcctaggtcagcccaaggctgccccctcggtccactctgttccct

SEQ ID NO: 784526 - DNA, 518 bp, Homo sapiens
  misc_feature: HIJSMM301DPPPJ.19.72.G06.1.454.light.4.raw
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtggcggcggagggaccaagggtgaccggtcctgggtcagcccgaaggctcgcccccctcgggtccacgtt

SEQ ID NO: 784527 - DNA, 493 bp, Homo sapiens
  misc_feature: HIJSMM301AZERC.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggtccttttggccgaggggaccaacctggagatcaaatgaactgtgctgcacatctgtctt

SEQ ID NO: 784528 - DNA, 508 bp, Homo sapiens
  misc_feature: HIJSMM301A8YAS.18.78.H01.1.454.light.4.raw
tacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctggaggacgaggctgattattactgcagctcatatacaagcagcagcactcaagtcttcggaactgggaccaaggaccacgcctaggtcagcccaacggccaacccactcgcta

SEQ ID NO: 784529 - DNA, 517 bp, Homo sapiens
  misc_feature: HIJSMM301CQRKZ.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcatggacccctgcccgattctcaggctccctccttggggcaaagctgccctgacactgtctggtgtgcagcctgaggacgaggctgactattactgcctactctactttggtggtgctgtgctattcggcggagggaccaaggctgaccgtcttaagtcagtcccaaggcctcgccccctcggtccactctcgttcccaccctt

SEQ ID NO: 784530 - DNA, 451 bp, Homo sapiens
  misc_feature: HIJSMM301E3YT6.18.9.A09.1.454.light.4.raw
  modified_base (414)..(414): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcgaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctntgtcactctgttccccaccctcctccatacctcgtaa

SEQ ID NO: 784531 - DNA, 487 bp, Homo sapiens
  misc_feature: HIJSMM301D8FX2.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgtctccaccttcggccaagggacacgactggagattaaacgaactgtggctgcaccat

SEQ ID NO: 784532 - DNA, 457 bp, Homo sapiens
  misc_feature: HIJSMM301B2G08.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggaggaccaggctgacgtcctaggtccgcccaaggctgccccctcggtcactctgttcccaccctcctcacgctatgt

SEQ ID NO: 784533 - DNA, 508 bp, Homo sapiens
  misc_feature: HIJSMM301D2B7M.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggccccagtctgccctgactcagcctgcctccgtgtctgggtctcctggacagtcgatcaccatctcctgcactggaaccagcagtgatgttgggggttatcaccttgtctcctggtaccaacaccaccccggcagagccccccaaactcatgatttatgaggccactaagcgaccctcagggctttctaatcgcttctctggctccaagtctggcaacacggcctccctgacaatctctgggctccaggctgacgacgaggctaattattactgctgctcatatgaaaggttataaacactatactattcgggcggagggaccaagctgaccgtcctgcgtcagccaaggctcgccccctggtccactcc

SEQ ID NO: 784534 - DNA, 497 bp, Homo sapiens
  misc_feature: HIJSMM301A905Y.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtatcggcggtgggaccaagctgaccgtcctaggtcagcccaaggcctgccccctc

SEQ ID NO: 784535 - DNA, 517 bp, Homo sapiens
  misc_feature: HIJSMM301B8NDN.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctcgccctgacactgtctggtgtgcagcctgaggacgaggctgactattactgcctactctacttggtggtgctgtgctattcggcggagggaccaagctgaccgtcttaagtcacgcccaaggctcgccccctcggtcactctcgttcccaccctcct

SEQ ID NO: 784536 - DNA, 502 bp, Homo sapiens
  misc_feature: HIJSMM301EYNRC.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaagtcagcccaaggccaaccct

SEQ ID NO: 784537 - DNA, 383 bp, Homo sapiens
  misc_feature: HIJSMM301EWBMQ.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttccgccatctgaattagtataga

SEQ ID NO: 784538 - DNA, 504 bp, Homo sapiens
  misc_feature: HIJSMM301CFDPD.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtcttcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgtattattattgctgctcatatgctaggtacgttacacttatgttcttggaattggggacgcggtcaccgtcctaggtcagcccaaggccaacccca

SEQ ID NO: 784539 - DNA, 488 bp, Homo sapiens
  misc_feature: HIJSMM301A2R3L.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtggatatcagacgtaa

SEQ ID NO: 784540 - DNA, 521 bp, Homo sapiens
  misc_feature: HIJSMM301EXM41.7.34.D01.1.454.light.4.raw
cgtgtctctacacgaccggtgctcgatttagatcgtctgtgttggggtttgggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacaccggcctccctgaccatctctggactccagactgaggacgaggctgattattactgctgctcatatacaggggacagctattagtttgggttggttcggcggagggaccagctgaccgtcctgcgtcacgccaaggctcgccccctcggtcacttcc

SEQ ID NO: 784541 - DNA, 478 bp, Homo sapiens
  misc_feature: HIJSMM301C8MX5.40.59.F04.1.454.light.4.raw
tctagcgactcacgaccggtgctcgatttagtacacacacttagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagccgggacccaggcctatggatgaggctgactattactgtcaggcggtggacatcagcagtgaggtggttttcgggcggacgggacaaggctgccgtccaacgtcagccc

SEQ ID NO: 784542 - DNA, 505 bp, Homo sapiens
  misc_feature: HIJSMM301AK116.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaaaacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcagttcggcgaagggaccaagggtggagatacaaacgaactgtggctgcaacc

SEQ ID NO: 784543 - DNA, 492 bp, Homo sapiens
  misc_feature: HIJSMM301EGD19.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcagtcagggtattagcaactggttagcctggtatcaacagaaaccagggaaagccccctaacctcctcatctctactgcatccactttgcaaagtgggtcccatcaaggttcagcggcagtggatctgggacagatttcactctcactatcagcagcctgcagcctgaagattttggaactttattattgtcaacagggtaacagtttcacgctcaccttcggcggagggaccaaggtggagataggaaaagaaacgtgtggctggcacc

SEQ ID NO: 784544 - DNA, 494 bp, Homo sapiens
  misc_feature: HIJSMM301BDVHJ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatgtgaatccaacagggccactggcatcccagacaggttcagtggcagtgggtctgggacagacttcactctcaccatcagcagactggagcctgaggattttggcagtgtattactgtcagcagtatcataggtcaaacaccttcggcaagggacacgactggagattaaaggaactagtggctgcaccatctgtcttcatcttccccg

SEQ ID NO: 784545 - DNA, 506 bp, Homo sapiens
  misc_feature: HIJSMM301A3ZXB.3.33.C11.1.454.light.4.raw
  modified_base (462)..(462): a, c, t, g, unknown or other
  modified_base (476)..(476): a, c, t, g, unknown or other
  modified_base (495)..(495): a, c, t, g, unknown or other
agacgcactccacgaccggtgctcgatttagagtgagctcgttgggtttgggggctttgcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatataacaaggagcaccactctcgtggtatttggtggagggaaccaagctgaccgtcctaggtcacgccaaggcncgccccctcggtcnctctcgttcccgccctccncgagtgcgtct

SEQ ID NO: 784546 - DNA, 489 bp, Homo sapiens
  misc_feature: HIJSMM301C1YVX.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcggctcgcattcggcggagggaccaaggtggagatcaaacgaa

SEQ ID NO: 784547 - DNA, 529 bp, Homo sapiens
  misc_feature: HIJSMM301AV9LQ.5.27.C05.1.454.light.4.raw
  modified_base (389)..(389): a, c, t, g, unknown or other
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggangaggccgactattactgtcaggtgtggaatggtgattatgattatgtcttcggaacgtgggaccgaaggtcaccgtcctaggtcacgcccaacggacccaaccccacctcgtcactctcgttcccaccctccctccgtgt

SEQ ID NO: 784548 - DNA, 483 bp, Homo sapiens
  misc_feature: HIJSMM301D33PW.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggagtgttgggctctatattgcatgcaagctctacagtcccgctcacttcggcggagggaccaaggtggagatacaaacgaa

SEQ ID NO: 784549 - DNA, 508 bp, Homo sapiens
  misc_feature: HIJSMM301CCWS9.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacagtcagtcaccatctcctgcactgcaaccagcagtgacgttggtggttcgaagtatgtctcctggtaccaacaacaccccgacaaagcccccaaactcatctatttttgaggtcactacgcgaccctcaggggtccctgatccgcttctctggctccaagtctggcaacacggccctcctgaccgtctctgggctccaggctgagatgaggctgattatactgcagctcatatgcaggcagcagcagtccccatgtgatcttcgggcgggggaccgaagctgaccgtcctaggtcacgcccaaggtcccg

SEQ ID NO: 784550 - DNA, 492 bp, Homo sapiens
  misc_feature: HIJSMM301ETWLX.47.55.E11.1.454.light.4.raw
agctcacgtacacgaccggtgctcgatttagcactcgcacgttgggtttgggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggcccaaccccactgtcactctgttcccgccctcctctacgtgagct

SEQ ID NO: 784551 - DNA, 479 bp, Homo sapiens
  misc_feature: HIJSMM301A0JCU.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggcgtgaggatggttgggctctattattgcatgcaagctctacaagtcccgctcacgtttcggcggagggaccaagggtggaga

SEQ ID NO: 784552 - DNA, 508 bp, Homo sapiens
  misc_feature: HIJSMM301AK2A5.5.86.H09.1.454.light.4.raw
  modified_base (392)..(392): a, c, t, g, unknown or other
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgacccgtctctgggctccanactgaggatgaggctgactattactgcagctcatttgcaggcagccgtatactcttcggcggagggaccaagctgaccgtcctaggtcagcccaaggcctgccccctcggtcctac

SEQ ID NO: 784553 - DNA, 524 bp, Homo sapiens
  misc_feature: HIJSMM301ESVMS.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggagggacgagggtgattatttctgcagctcatttacaaccagccacaccttgctcttcggaactgggaccacggtcatcgtcctaggtccagccccaaggccaaccccactcgtcactctgttcccaccctcct

SEQ ID NO: 784554 - DNA, 487 bp, Homo sapiens
  misc_feature: HIJSMM301BK8O6.9.59.F04.1.454.light.4.raw
tgatacgtctcacgaccggtgctcgatttagtacacacacttagggagttgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtgctgcaccat

SEQ ID NO: 784555 - DNA, 502 bp, Homo sapiens
  misc_feature: HIJSMM301C2DVX.22.36.D03.1.454.light.4.raw
acatacgcgtcacgaccggtgctcgatttagctgcgtcacgatctctcttgggggggggtctcaggaggcagcgctctcgggacgtctccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtctaggtcagcccaaggctgccccctc

SEQ ID NO: 784556 - DNA, 498 bp, Homo sapiens
  misc_feature: HIJSMM301CWNNE.53.22.B11.1.454.light.4.raw
cgcgtatacacacgaccggtgctcgatttagacgacagctcagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcactccttccg

SEQ ID NO: 784557 - DNA, 497 bp, Homo sapiens
  misc_feature: HIJSMM301EZMKR.16.53.E09.1.454.light.4.raw
  modified_base (477)..(477): a, c, t, g, unknown or other
tgtactactccacgaccggtgctcgatttagagagagtgtgttgggtttggggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttaggggtttagtttactgcatgcaagctctacaaactccttacacttttggccgagggaccaagcnggagataccaaagaactagt

SEQ ID NO: 784558 - DNA, 442 bp, Homo sapiens; identical to SEQ ID NO: 563958
  misc_feature: HIJSMM301AELKY.11.3.A03.1.454.light.4.raw

SEQ ID NO: 784559 - DNA, 500 bp, Homo sapiens
  misc_feature: HIJSMM301AI62R.3.37.D04.1.454.light.4.raw
  modified_base (389)..(389): a, c, t, g, unknown or other
  modified_base (424)..(424): a, c, t, g, unknown or other
  modified_base (442)..(442): a, c, t, g, unknown or other
  modified_base (485)..(485): a, c, t, g, unknown or other
agacgcactccacgaccggtgctcgatttagtagcatactgttgggtttgggggatcaggactcctcagttcaccttctcacaatgaggctccctgctcagctcctggggctgctaatgctctgggtctctggatccagtggggacattgtcatgactcagtctccactctccctggccgtcacacctggagagacggcctccatctcctgcaggtctagtgagagcgtccagggtaatggatacgactatttggattggtacctgcagaagccagggcagcccccacaactcctgatctacttggcttctaatcgggcctccggggtccctgacaggttcagcggcagtggatcgaggcacagtattttaaactgaataatcagccgngtggaggctgaggatgttgggatttatactgcgtncaagttcgacaaaccccnttcacttcggccctgggaccaagtggacatcaaaacgaactgnggctgcaccatctgt

SEQ ID NO: 784560 - DNA, 520 bp, Homo sapiens
  misc_feature: HIJSMM301CO3PA.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactccatttatagtacaaacaacaaacactacctggacccctgcccgattctcaggctccctccttggggcaaagctgccctgacactgtctggtgtgcagcctgaggacgaggctgactattactgcctactctactttggtggtgttgtgctattcggcggagggaccaagctagaccgtcttaagtcacgcccaaggctcgccccctcggtcactctcgttcccaccctt

SEQ ID NO: 784561 - DNA, 487 bp, Homo sapiens
  misc_feature: HIJSMM301AG47C.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataactctccccactttcggccctgggaccaaagtggatatacaaacgactgtggctgcaccatctgtt

SEQ ID NO: 784562 - DNA, 511 bp, Homo sapiens
  misc_feature: HIJSMM301DGCB7.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtaggtggtgatcatccatacgtcttcggaactgggaccaaggtctccgtcctacgtcagcccaaggccaacccactgtcactctcgttcccta

SEQ ID NO: 784563 - DNA, 488 bp, Homo sapiens
  misc_feature: HIJSMM301EE864.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctactcacttcggcggacgggaccgaaggtggagatacaaacgaact

SEQ ID NO: 784564 - DNA, 540 bp, Homo sapiens
  misc_feature: HIJSMM301CTRAG.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaacaactcctgaccctgcccgattctcaggctcctccttggggcaaagctgccctgacactgtctggtgtgcagcctgaggacgaggctgactattactgcctactctactttggtggtgctgtgctattcggcgggtacgggaccgaacgctacgaccggtcctttaagttcacgcccaaggcctcgccccccgtcggtcgaccttctcggttccccgcccgtcccttccccg

SEQ ID NO: 784565 - DNA, 515 bp, Homo sapiens
  misc_feature: HIJSMM301E24BS.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgcctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagacaatagtacgttttcggcggtagggaccaagctagaccgtccgtggggtcacggcccaacggctcgcccccgtcggtacc

SEQ ID NO: 784566 - DNA, 512 bp, Homo sapiens
  misc_feature: HIJSMM301D4VYB.16.10.A10.1.454.light.4.raw
tgtactactccacgaccggtgctcgatttagcgtcgatctcagggggtgggtccgaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtaggtggtgatatataaagacaacacagaggccctcgacgggatcccgtgggccgtattctctggctccagctcagggacgacagtcacgttgaccatcggtggagtccaggcagaagacgagggtgactatactgtcagtctgcaaacaccactgcagcggtgttcggcggagggaccaagctgacccgtctgcgtcagcccaaggcctcgccccctcggtccactctcgttcccctacccc

SEQ ID NO: 784567 - DNA, 530 bp, Homo sapiens
  misc_feature: HIJSMM301BBM0K.13.77.G11.1.454.light.4.raw
tcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggccccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcagtgtggtagttcgggcggtagggaccaaacgtcgaccggtcctaggtcagcccaaggcctcgccccctcggtcactctcgtcccaccctcct

SEQ ID NO: 784568 - DNA, 492 bp, Homo sapiens
  misc_feature: HIJSMM301EXQZ6.48.79.H02.1.454.light.4.raw
agtatacatacacgaccggtgctcgatttagtgtcacacgaagggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagtactttgctagtttattactgtcagcagtatgataactggccttccgttccaccgttcggcggtcgggaccaagggtggagatacaaacgaa

SEQ ID NO: 784569 - DNA, 450 bp, Homo sapiens; identical to SEQ ID NO: 606269
  misc_feature: HIJSMM301CN84T.18.9.A09.1.454.light.4.raw

SEQ ID NO: 784570 - DNA, 509 bp, Homo sapiens
  misc_feature: HIJSMM301E0Y6N.9.12.B01.1.454.light.4.raw
tgatacgtctcacgaccggtgctcgatttagtagtgtagattcggcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcgggaagtgggaccacggtcaccgtcctaggtcagcccaacggccaacccccgactagtcacttc

SEQ ID NO: 784571 - DNA, 501 bp, Homo sapiens
  misc_feature: HIJSMM301DSRX9.40.54.E10.1.454.light.4.raw
tctagcgactcacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggttacttttcgggttttcggcggagggaccaagctgaccgtcctaggtcagcccaaggcctcgtccccccg

SEQ ID NO: 784572 - DNA, 486 bp, Homo sapiens
  misc_feature: HIJSMM301EAPGU.18.59.F04.1.454.light.4.raw
  modified_base (439)..(439): a, c, t, g, unknown or other
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatccggccctcaggggtttctaatcgcttctctggctccaagtctggcaacacggcctccctgaccatctctgggctccaggctgaggacgaggctgattattactgcagctcatatacaagcaccngcactctctatgtctcggaactgggaaccaggtcaccgtctaggtca

SEQ ID NO: 784573 - DNA, 510 bp, Homo sapiens
  misc_feature: HIJSMM301B6PGZ.43.34.D01.1.454.light.4.raw
tgtgagtagtcacgaccggtgctcgatttagatcgtctgtggttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgacgttggaacttatgaccatgtctcctggtaccaacaataccaggcaaagcccccaaactcttgatttatgatgtcacttatcggccctcaggggtttcttatcgcttctctggctccagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctcgccccctcggtcactc

SEQ ID NO: 784574 - DNA, 509 bp, Homo sapiens
  misc_feature: HIJSMM301D9DNH.40.4.A04.1.454.light.4.raw
tctagcgactcacgaccggtgctcgatttagagtagtgatcagggggagctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaattccggggtccctgaccgattccgtggcagtgggtccgggacagattttactctcaccatcaccagccttcaggctgaagatgtggcagtttattactgtcaccaaattatttaagactattcctccgaccgttcggtccaagggacccaaggtggagatcaaacgaactgtggctgcaccatctgtctt

SEQ ID NO: 784575 - DNA, 541 bp, Homo sapiens
  misc_feature: HIJSMM301BAQQ9.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgaggtcactaagcggccctacaggggtttctggtcgcttctctgcctccaagtctggcaacacggcctcctgacaatctctgggctccagtctgacgacgaggctgattattactgcagctcatatgctaggttggtttccttctttacgaagattagttcgggcgggaagggtacccagggccttacggacccgttaccgtgaacggtcaacggcccgaaggcctccggtcccccccg

SEQ ID NO: 784576 - DNA, 512 bp, Homo sapiens; identical to SEQ ID NO: 581887
  misc_feature: HIJSMM301ED74H.17.33.C11.1.454.light.4.raw

SEQ ID NO: 784577 - DNA, 497 bp, Homo sapiens
  misc_feature: HIJSMM301AOWAY.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccgaggggaccaagctggagatcaaacgaactgtgctgcaccatctgtt

SEQ ID NO: 784578 - DNA, 492 bp, Homo sapiens
  misc_feature: HIJSMM301AKDBG.51.38.D05.1.454.light.4.raw
cgatcgtatacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggcgaggctgactattattgtcaatcaacagaccacacttggtacttagtgtcttcggaactgcgaccaaggtcaccgtctaggtcagcccaaggcccaacccac

SEQ ID NO: 784579 - DNA, 492 bp, Homo sapiens; identical to SEQ ID NO: 537703
  misc_feature: HIJSMM301A9R9H.16.68.G02.1.454.light.4.raw

SEQ ID NO: 784580 - DNA, 490 bp, Homo sapiens
  misc_feature: HIJSMM301ALL7Q.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcacatcagcagcctccaacgtgatgatgttgcaacatactatttgtcagcaaatatgtattttgctcctccgagtgcctacgtttttgggccggggggtaccaagggtaggacagtaccaaaccgaacttc

SEQ ID NO: 784581 - DNA, 498 bp, Homo sapiens
  misc_feature: HIJSMM301BMMRW.52.82.H05.1.454.light.4.raw
  modified_base (442)..(442): a, c, t, g, unknown or other
  modified_base (485)..(485): a, c, t, g, unknown or other
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttacttatgtcttcgcaacngggtaccaaggtcaccgtcctaggtcagccaaggcccaacccnctgtcacttcccg

SEQ ID NO: 784582 - DNA, 484 bp, Homo sapiens
  misc_feature: HIJSMM301DJBZ0.3.77.G11.1.454.light.4.raw
  modified_base (461)..(461): a, c, t, g, unknown or other
agacgcactccacgaccggtgctcgatttagctagtcactcaaggggaaagggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggcctcgtgacattcggcaaggtccaaggtgganatcagacactgtggctggcaccc

SEQ ID NO: 784583 - DNA, 526 bp, Homo sapiens
  misc_feature: HIJSMM301CIQ0L.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactcgtccccaaactcattctttatgatgtcagtatcggcccccagggtttctgatcgcttctatggctccaagtctgcctacacggcctccctgaccatctccgggcctccagcctgaggacgaggctgattattattgttagttcatatacaaccagtgacactttgggtgttcggcggagggaccaggctgaccgtcctaggtcagcccaaggcctgccccctcggtcactctcgttcccaccct

SEQ ID NO: 784584 - DNA, 489 bp, Homo sapiens
  misc_feature: HIJSMM301ASCFR.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagccctgacctcctgatctatgctgcatccagtttgcacagtggggtcccgtcaaggttcagtggcagtggatctgggacagatttcactctcaccgtcagcagtctgcaacctgaagattttgcaacttactactgttcaacagagttacacgtacccccctcactttcggcgagggaccaagggcggagatacagacgaactgtggctgcacatctgtctcta

SEQ ID NO: 784585 - DNA, 494 bp, Homo sapiens; identical to SEQ ID NO: 534992
  misc_feature: HIJSMM301A5VHN.9.1.A01.1.454.light.4.raw

SEQ ID NO: 784586 - DNA, 511 bp, Homo sapiens
  misc_feature: HIJSMM301C2G1R.53.33.C11.1.454.light.4.raw
cgcgtatacacacgaccggtgctcgatttagagtgagctcgttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaagaaatatgcttattggtaccagcagaggtcaggccaggcccctgtgctggtcatctatgaggacaccaaacgaccctccgggatccctgcgagattctctggcgccagctcagggaccagtggccaccctgacagtcagtggggcccaggtcggaggatgaagctgattactactgttactctaacagacaggagtggaaatcataggtaattcggcggagggaccgaaactcggaaccgtcctaggtcagcccaaggctcgcccctcggtctaccg

SEQ ID NO: 784587 - DNA, 492 bp, Homo sapiens
  misc_feature: HIJSMM301BQV1J.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatcgtgggaccagggtcaccgtcctaggtcagcccaaggcccaaccccc

SEQ ID NO: 784588 - DNA, 523 bp, Homo sapiens
  misc_feature: HIJSMM301AKNGL.9.21.B10.1.454.light.4.raw
  modified_base (373)..(373): a, c, t, g, unknown or other
tgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctcccngacaatctctgggctccagtctggacgacgaggctgattattactgcagctcatatgcagttggttcctcttttcaagtatagttcggcggtaggggaccaggcctgacccggttcctgacgtcacgtacccaaggcctcgtcccccccg

SEQ ID NO: 784589 - DNA, 514 bp, Homo sapiens
  misc_feature: HIJSMM301CH6X7.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactggaggacgaggctgattattactgctgctcatatacaggggacagcatttatttgggtgttcgggcggagggaccaagctgaccgtcctgcgtcagcccaagctgcccctcggtcactcc

SEQ ID NO: 784590 - DNA, 322 bp, Homo sapiens; identical to SEQ ID NO: 543831
  misc_feature: HIJSMM301BTBUG.49.44.D11.1.454.light.4.raw

SEQ ID NO: 784591 - DNA, 509 bp, Homo sapiens
  misc_feature: HIJSMM301DBXPI.51.43.D10.1.454.light.4.raw
cgatcgtatacacgaccggtgctcgatttagactagcagtaaggggagtctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctgtgggggagacaacattggaagtaaaagtgtacactggtaccagcagaggccaggccaggcccctgtgttggtcgtctatgattataacgaccggccctcagggatccctgaccgattctctggctccatctctgggaacacggccactctgaccatcagcagggtcgaagccggggatgaggccgactattactgtcaggtgtgggaagtagtagtgatcattatgtcttcggaagtggacaggtcacgtcctaggtcagcccaaggccacccactgtcactctcgtccaccctcctctcg

SEQ ID NO: 784592 - DNA, 500 bp, Homo sapiens
  misc_feature: HIJSMM301EEMOE.5.12.B01.1.454.light.4.raw
  modified_base (302)..(302): a, c, t, g, unknown or other
atcagacacgcacgaccggtgctcgatttagtagtgtagattccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccaacagtgacattggtgcttaatgactatgtctcgtggtatcaaaaagtatccagacacagcccccaaactcatcctttangatgtccgtgttcggcctcaggggtttctgttcgcttctctggctccaagtctggcagcacggcctccctgaccatctctgggctccaggctgaggacgaggctgactattattgcagttcatatggtagtatgaagactcttgtgtattttcggcggagggaccaaggctgaccgtcctgagtcagcccaaggctcc

SEQ ID NO: 784593 - DNA, 491 bp, Homo sapiens
  misc_feature: HIJSMM301DEJYF.46.26.C04.1.454.light.4.raw
  modified_base (481)..(481): a, c, t, g, unknown or other
actagcagtacacgaccggtgctcgatttagtctagcgactttgggtttggggtgatcaggactcctcagttcaccttctcacaatgaggctccctgttcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactagaaaatcaagcagagtggaggctgaggagtgttgggctctattattgcatgcaagctctacaagtcccgctcactttcggcgggagggaccgaaggtggaganacaaacgact

SEQ ID NO: 784594 - DNA, 509 bp, Homo sapiens
  misc_feature: HIJSMM301D4FEO.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcaggtttattaactgtcagcaatattatagtactcctccgacggctcactttacggcggtaggggaccgaagggtggaacggataccaaacgtaaact

SEQ ID NO: 784595 - DNA, 522 bp, Homo sapiens
  misc_feature: HIJSMM301CC8NX.48.29.C07.1.454.light.4.raw
  modified_base (518)..(518): a, c, t, g, unknown or other
agtatacatacacgaccggtgctcgatttagagtgctacgaagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactgggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggagtagtagtagtgatcatcctaattggtgttcggcggagggaccaagctgaccgtcctaggtcagcccaaggctcgccccctcggtcactctcgttcccnccct

SEQ ID NO: 784596 - DNA, 480 bp, Homo sapiens
  misc_feature: HIJSMM301AIKYJ.16.86.H09.1.454.light.4.raw
tgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctcgccccctcggtcactctgttcccaccctcctcgagtagtaca

SEQ ID NO: 784597 - DNA, 501 bp, Homo sapiens
  misc_feature: HIJSMM301E3VKL.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcaccgtgggtacttttggcctaggggaccaagctggagatacaaacgaactagtggctgcaccatctgtctt

SEQ ID NO: 784598 - DNA, 506 bp, Homo sapiens
  misc_feature: HIJSMM301CFK9O.40.41.D08.1.454.light.4.raw
  modified_base (476)..(476): a, c, t, g, unknown or other
tctagcgactcacgaccggtgctcgatttagtcacgcgagaaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgtcttctctggctccaagtctggcaacaccggcctccctgaccatctctgggctccaggctgaggacgaggctgattattactgcagctcatatacaagcagcagcactccccatgtggtattcggcggagggaccaagcngaccgtctaggcagcccaggctcgcccccg

SEQ ID NO: 784599 - DNA, 508 bp, Homo sapiens
  misc_feature: HIJSMM301E28OZ.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatccgaccttcaggggtccctgaccggttctctggctccaagtctggctcttccgcctccttggccatcactgggctcgaggctgacgatgaggctgattactactgtctgttcctatgacgacgacctacagactccggttttcggcggagggactaagctgaccgtcctaggtcagcccaaggctgccccctcggtcactctgttcccg

SEQ ID NO: 784600 - DNA, 513 bp, Homo sapiens
  misc_feature: HIJSMM301AXF4G.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatagaaaactacttagcttggtaccagcagagaccaggacagcctcctaggctgctcatttactgggcatctacccgggaatcccggggtccctgaccgattcagtggcaggcgggtcgtgggacagatttcactctacaccatcagcagccctgcaggctgaaagatgtggctagttttattattgtcaaactaatatttattaatacttcggtggtaccgttcggtccgaagggaccgaaggtagggatatcagacgtaactggt

SEQ ID NO: 784601 - DNA, 493 bp, Homo sapiens
  misc_feature: HIJSMM301D52T2.48.85.H08.1.454.light.4.raw
agtatacatacacgaccggtgctcgatttagtatcactcagtcgcagggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgagctgactattattgctcagcagtcgggacaccagcctcaaatggccgcgggttattccggcggtccaagggaccaagctacggacccgtcctaggt

SEQ ID NO: 784602 - DNA, 497 bp, Homo sapiens
  misc_feature: HIJSMM301BOQ3V.4.24.C02.1.454.light.4.raw
agcactgtagcacgaccggtgctcgatttagtacagatcgttagggaaaggggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgctaacttattactgtacaacaataataacagttaattggacgttcggccgaaggaccgaaggtggaaatcagaacgactgtggctgcaccatctgtcttcta

SEQ ID NO: 784603 - DNA, 494 bp, Homo sapiens
  misc_feature: HIJSMM301AGYXR.5.71.G05.1.454.light.4.raw
atcagacacgcacgaccggtgctcgatttagtgtcgtcgcaagagagaggggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtgtcttacacagctccagcaataagaaccacttagcttggtaccagcagaaaccaggacagcctcctaaggtactcatttactgggcatctacccggggatccggggtccctgaccgattcagtggcagcgggtctgggacagatttcactctcaccatcagcagtctgcaggctgaagatgtggctagtttattactgtcagcaatattataccactccgtgctagttttcggccgttggggaccaagcgtggagatcaaacgaact

SEQ ID NO: 784604 - DNA, 499 bp, Homo sapiens
  misc_feature: HIJSMM301A74FK.48.39.D06.1.454.light.4.raw
agtatacatacacgaccggtgctcgatttagtgacatctcgcagttctttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcacccttcggccaagggacacggactggagattaaccgaactggtggctgcaccatcttgtctt

SEQ ID NO: 784605 - DNA, 462 bp, Homo sapiens
  misc_feature: HIJSMM301CCDCY.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctcgttcccaccctcctcgtactctctcg

SEQ ID NO: 784606 - DNA, 495 bp, Homo sapiens
  misc_feature: HIJSMM301CPWJZ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagtttgtgttgacgcagtctccaggcaccctgtctttgtctccagggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcactctcaccatcagcagactggagcctgaagattttgcagtctattactgtcagcagtatggtcacgtcccaagaacttttggccaggggaccaagctggagatacaaacgaactgtggctgcaccatcttcg

SEQ ID NO: 784607 - DNA, 477 bp, Homo sapiens
  misc_feature: HIJSMM301BGD9E.49.35.D02.1.454.light.4.raw
agtcgagagacacgaccggtgctcgatttagcacacgatagttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagatttgcagtttatactgtcagcagtataattactgctcgttttggccagggccaagctggagatcaagcgaactgtggctgcaccat

SEQ ID NO: 784608 - DNA, 496 bp, Homo sapiens
  misc_feature: HIJSMM301ARKNU.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttggttctaatcgggcctccggggtccctgacaggttcagtggcagtggatcaggcacagattttacactagaaaatcagcagagtggaggctgaggatgttgggctcttattattgcatgcaagctactacaacgtcccgctcctacgtttcggccgggaggggaccgaagggtgaggatcaaaacgac

SEQ ID NO: 784609 - DNA, 505 bp, Homo sapiens
  misc_feature: HIJSMM301AP27O.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtccgtggtcagcccaaggcctgccccctcggtcta

SEQ ID NO: 784610 - DNA, 515 bp, Homo sapiens
  misc_feature: HIJSMM301D4V3H.48.60.F05.1.454.light.4.raw
  modified_base (427)..(427): a, c, t, g, unknown or other
agtatacatacacgaccggtgctcgatttagtacgtcatcagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagaattttacactagaaaatcagcagagtggaggctgaggatggttggggtttatactgcatcgnaagctctacaaactcctcgggcgtcggtaccaagggaccgaacgggtaggtaagaactaaacgaactacggtggtcgtgacgacctaa

SEQ ID NO: 784611 - DNA, 447 bp, Homo sapiens
  misc_feature: HIJSMM301EXONM.8.73.G07.1.454.light.4.raw
  modified_base (173)..(173): a, c, t, g, unknown or other
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccnggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggcctcgccccctcggtcactctcgttcccaccctcctcgacacgcgag

SEQ ID NO: 784612 - DNA, 514 bp, Homo sapiens
  misc_feature: HIJSMM301ADB94.5.86.H09.1.454.light.4.raw
atcagacacgcacgaccggtgctcgatttagtgctatagacgttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgctaggcagccgtatactcttcggcggagggaccaagctcgaccgtccgtaggtcacgcccaaggctcgccccctcggtcctacc

SEQ ID NO: 784613 - DNA, 423 bp, Homo sapiens
  misc_feature: HIJSMM301DAW8D.41.12.B01.1.454.light.4.raw
tctatactatcacgaccggtgctcgatttagtagtgtagattccgcgggcacgaccggtgctcgatttagtagtgtagatttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgctaatttattactgtcaccagtatggtagttcacctctaactttcggcggagggaccaaggtggagatcaaacgaactgtggctgcaccatctgtcttcatcttcccgccatctgaatagtataga

SEQ ID NO: 784614 - DNA, 501 bp, Homo sapiens
  misc_feature: HIJSMM301DJ6BG.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatggtcggggtttactactgcatgcagggtacactctggccgttctacgttttggccgacggggaccaaacgtggagtaatcagacgaactgtggtcgtgcca

SEQ ID NO: 784615 - DNA, 511 bp, Homo sapiens
  misc_feature: HIJSMM301D7FDC.3.4.A04.1.454.light.4.raw
agacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggcccaggccaatctccaaggcgcctaatttataaggtttctaaccgggactctggggtcccagacagattcagcggcagtgggtcaggcactgatttcacactgaaaatacagcgagggtggaggctgaggatggttggggtttattactgcatgcaaggtacacactggcctccgacgttcggtccgacgggaccgaaggtaggaaatacaaacgaactagtggctgcaccattctgttcttc

SEQ ID NO: 784616 - DNA, 499 bp, Homo sapiens; identical to SEQ ID NO: 538208
  misc_feature: HIJSMM301D7FTK.40.65.F10.1.454.light.4.raw

SEQ ID NO: 784617 - DNA, 514 bp, Homo sapiens
  misc_feature: HIJSMM301DCX5Y.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgctagtttattactgtcaacagcgtagcagcaggcctccggcgacgttcggccaagggaccaaggtggaagtcaagcgaacgtgtggctgcaccatctgtcttcatccttcccgccatcg

SEQ ID NO: 784618 - DNA, 488 bp, Homo sapiens
  misc_feature: HIJSMM301B0O4I.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagccctacagcctgatgtattttgcgtacttattattgccaacagtaataagagtttattcaactttcggccctgggaccaatgtggatatacaaacgaactgtggctgcaccatctgtt

SEQ ID NO: 784619 - DNA, 518 bp, Homo sapiens
  misc_feature: HIJSMM301BBN5J.43.59.F04.1.454.light.4.raw
tgtgagtagtcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaacgcccccaaactcttgatttatgatgtcacttatcggccctcagggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggcctcgccccctcggtcactcctcgtt

SEQ ID NO: 784620 - DNA, 507 bp, Homo sapiens
  misc_feature: HIJSMM301AWC34.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcaggtggagtccaggcagaggacgagctgactattattgtcaatcaacagacacctattggttacttattgtcttacggaatcgacgaccaaggtcaccgtcctgggtcagcccaaggcccaaccccactcgtcacttccg

SEQ ID NO: 784621 - DNA, 498 bp, Homo sapiens
  misc_feature: HIJSMM301D15E0.3.10.A10.1.454.light.4.raw
  modified_base (434)..(434): a, c, t, g, unknown or other
agacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttattggtaccaacaaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcaagacaacaagtaatacttatctttangtacttcggatacgtggacctagggtccaccgtcctaggtccagcccaaacggcccaaacccca

SEQ ID NO: 784622 - DNA, 526 bp, Homo sapiens
  misc_feature: HIJSMM301BY439.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattattctgcagctcatttacaaccagccacaccttgctcttcggaactgggaccacggtcatcgtcctaggtcagcccaaggcccaacccccactcgtcactcctcgttccccaccctccta

SEQ ID NO: 784623 - DNA, 520 bp, Homo sapiens
  misc_feature: HIJSMM301DH145.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggcctgccccctggtccactctgttcccccc

SEQ ID NO: 784624 - DNA, 527 bp, Homo sapiens
  misc_feature: HIJSMM301C9LPA.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaacccagcagtgatggttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgttcttacggaacttgggaccaaggtccaccggttacctaggttcacggaccccaaaggccccaaaccccgtactcggtccta

SEQ ID NO: 784625 - DNA, 489 bp, Homo sapiens
  misc_feature: HIJSMM301API0Q.3.59.F04.1.454.light.4.raw
agacgcactccacgaccggtgctcgatttagtacacacacttagggattgggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacaccgacttggattggtttcaacagaggccaggccaatctccaaggcgcctaatttataaggtttctaagcgcgactcgtggggtccagacagattcagcggcagtgggtcaggcactgacttcacactggaaatcagcagggtggaggctgaggatgttgcggtttattactgcatgcaatatacacaataggcctcacacctttggccaaggggaccaagctaggagatacaaacgaa

SEQ ID NO: 784626 - DNA, 498 bp, Homo sapiens
  misc_feature: HIJSMM301BJ8R1.22.57.F02.1.454.light.4.raw
  modified_base (361)..(361): a, c, t, g, unknown or other
  modified_base (416)..(416): a, c, t, g, unknown or other
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtgggtcccatcaaggttcagcggcactggatctgggacagaattcactcncaccatcaacagcctgcagcctgatgattttggcaacttactactgccaaccgtntagtacttattcggtcaccttcggccaagggacacggactggaagattaaacgaactgtggctgcaccatctgtacttcatt

SEQ ID NO: 784627 - DNA, 486 bp, Homo sapiens
  misc_feature: HIJSMM301AIHF5.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcaggtgggtctgggacagagttcactgtcaccatcagcagcctgcagtctgaagattttgctagtttattactgtcagcagtataatagctggcccgcgacgtcggccaagggaccgaggtggaattcaaacgactgtggctgcaccatctgtctt

SEQ ID NO: 784628 - DNA, 519 bp, Homo sapiens
  misc_feature: HIJSMM301A68R5.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcaggtgggtctgggacagacttcattctcaccatccgcagcctagagcctgaagtattttgctagtttattactgtcaacagcgtagcagcaggcctccggcgaccgtcggccgaacgggaccgaaggtaggaagtcgaagcgaactgtggctgcaccatctcgttcttcatccttcccgcc

SEQ ID NO: 784629 - DNA, 489 bp, Homo sapiens
  misc_feature: HIJSMM301D5UTH.46.26.C04.1.454.light.4.raw
  modified_base (406)..(406): a, c, t, g, unknown or other
actagcagtacacgaccggtgctcgatttagtctagcgactttgggtttgggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctcggggtccctgacaggttcagtggcagtggatcaggcacagattttacacgtgaaaatcagcagagtggaggctgaggangttgggctctattattgcatgcaagctctacaagtcccgctcactttcggcggagggaccaaggtggacgatcaacgaactcg

SEQ ID NO: 784630 - DNA, 518 bp, Homo sapiens
  misc_feature: HIJSMM301ESCB0.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaaggccggggatgaggccgactattactgtcaggtgtggaatggtgattatgattatgtcttacggaactgggaccaaggtcaccgtcctaggtcagcccaacggccaacccactgtcactctcgtcccaccctcct

SEQ ID NO: 784631 - DNA, 499 bp, Homo sapiens
  misc_feature: HIJSMM301C7F7I.43.25.C03.1.454.light.4.raw
tgtgagtagtcacgaccggtgctcgatttagtagtgtagatttgggtttgggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatggttggggtttattactgcatgcaaggtacacactggcccgtcaccttcggccaagggacacgactggagattaaacgaactgtggctgcaccta

SEQ ID NO: 784632 - DNA, 513 bp, Homo sapiens
  misc_feature: HIJSMM301C57KB.16.66.F11.1.454.light.4.raw
  modified_base (447)..(447): a, c, t, g, unknown or other
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagcnggccgtcctaggtcagcccaaggctgcccctcggtcactctgttcccgccctcctcgagtagtaca

SEQ ID NO: 784633 - DNA, 527 bp, Homo sapiens
  misc_feature: HIJSMM301EZJX3.3.87.H10.1.454.light.4.raw
agacgcactccacgaccggtgctcgatttagcagtactgcgttgggtttgggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgctagctcatacacaaccggcaccactgtcggttggttttcggtggagggaccaagcgtgaccgtctaaggtcagcccaaggcctcgccccctcggtcaccttc

SEQ ID NO: 784634 - DNA, 479 bp, Homo sapiens
  misc_feature: HIJSMM301DKR2V.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtggggacaggcagcactcgcccgctatgtcgttcggaactgggaccaaggtcaccgtcctaagcaacgg

SEQ ID NO: 784635 - DNA, 508 bp, Homo sapiens
  misc_feature: HIJSMM301EJ6GM.10.27.C05.1.454.light.4.raw
catagtagtgcacgaccggtgctcgatttagacgcgatcgaaggggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctcaagtctggcaacacggcctccctgacaatctctgggctccaggctgacgacgaggctgaatattactgcagctcatatgtagatggtgcctctttcaaggttttcggcggagggacaggctgaccgtcctaagtcagacccaaggctcgccccctcggt

SEQ ID NO: 784636 - DNA, 493 bp, Homo sapiens
  misc_feature: HIJSMM301EAILW.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtacggagagtcaaacgaa

SEQ ID NO: 784637 - DNA, 532 bp, Homo sapiens
  misc_feature: HIJSMM301A7YRM.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaacgattttgctaacttactactgtctaacagagtttcagtcgtcccccggacgttcgcacgggacgaccgagtacgaaagtagtaggacgaaacgttacgtggcgtacgtctaccgactacctgttcttacctacttccttcccgtt

SEQ ID NO: 784638 - DNA, 334 bp, Homo sapiens; identical to SEQ ID NO: 728867
  misc_feature: HIJSMM301A3ZH9.4.39.D06.1.454.light.4.raw

SEQ ID NO: 784639 - DNA, 492 bp, Homo sapiens
  misc_feature: HIJSMM301D2CSI.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatacaaacgaactagtggctcgcaccta

SEQ ID NO: 784640 - DNA, 445 bp, Homo sapiens; identical to SEQ ID NO: 546163
  misc_feature: HIJSMM301BQWTN.9.9.A09.1.454.light.4.raw

SEQ ID NO: 784641 - DNA, 502 bp, Homo sapiens
  misc_feature: HIJSMM301DZAD6.12.26.C04.1.454.light.4.raw
  modified_base (250)..(250): a, c, t, g, unknown or other
  modified_base (497)..(497): a, c, t, g, unknown or other
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgngaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttattttgtcagcaatattatcatactccgctcactttcggcggagggaccaaggtggagatcaaacgaacctgtggctgcncctaa

SEQ ID NO: 784642 - DNA, 480 bp, Homo sapiens
  misc_feature: HIJSMM301ANLE7.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcagctgaagatgtggcagcttattattgtcagcaatattatacttctcttccgatctacttttggccaggggaccaggctggagatcagacgaa

SEQ ID NO: 784643 - DNA, 446 bp, Homo sapiens
  misc_feature: HIJSMM301EI6PY.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgtattattactgtcagttcctttgacattaaactggatgtggtattcggcggacgggacccacgtaaccgtcctaggtcagcccaaggctcgccccctcggtcactctcgttcccaccctcctcgtatctctcg

SEQ ID NO: 784644 - DNA, 418 bp, Homo sapiens
  misc_feature: HIJSMM301CSMSR.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcaggggtttctaatcgcttctctggctccaagtctggcaacacggcctccctgaccatctctgggctccaggctgaggacgaggctgatttattactgcagctcatatacaagcagcagcactcaagtcttcggactgggaccaaggtcaccgtcctaggtcagcccaaggcccaacccactgtcactctcgttcccgccctcctccatactcgta

SEQ ID NO: 784645 - DNA, 505 bp, Homo sapiens; identical to SEQ ID NO: 595357
  misc_feature: HIJSMM301CJ307.49.31.C09.1.454.light.4.raw

SEQ ID NO: 784646 - DNA, 477 bp, Homo sapiens
  misc_feature: HIJSMM301DYNS7.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattacttgtacaaaagaataagcgctcgccccgctcagtttcgggcggtagggaccgaaggtgggagataaccg

SEQ ID NO: 784647 - DNA, 512 bp, Homo sapiens
  misc_feature: HIJSMM301D9SQ1.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacgacctccctgaccatctctgggctccaggctgatgacgaggctgattattactgcaggtcatatacaatcagcaacacttatgtcttcgggactgggaccaagatcaccgtcctaggtcacgcccaacggcccaaacccccactcgtctacc

SEQ ID NO: 784648 - DNA, 502 bp, Homo sapiens
  misc_feature: HIJSMM301CWFUN.15.57.F02.1.454.light.4.raw
tctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataacttttgtctcctggtaccaacaacacccaggcaaagcccccaaatcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggaggggaccaagctgaccgtcctaggtcagcccaaggctgcccctcggtcactctgttcccaccctcctcgctacgtaga

SEQ ID NO: 784649 - DNA, 502 bp, Homo sapiens
  misc_feature: HIJSMM301AKFVW.49.46.E02.1.454.light.4.raw
agtcgagagacacgaccggtgctcgatttagactcatctacaggggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcttagagcctgaagtattttgctagtttatttactgtcagcagcgtagcaactcggcctctcacttcggcgggagggaccgaaggtcggagatacaaacgaacgtggtggctgcaccatctgtctt

SEQ ID NO: 784650 - DNA, 513 bp, Homo sapiens
  misc_feature: HIJSMM301EY37B.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggaccctgcccgattctcaggctcctccttgggggcaaagctgccctgacactgtctggtgtgcagcctgaggacgaggctgactattactgcctactctactttggtggtgctgtgctattcggcggagggaccaagctgaccgtcgttaacgtcagcccaaggctcgccccctcggtcactctcgttcccta

SEQ ID NO: 784651 - DNA, 476 bp, Homo sapiens
  misc_feature: HIJSMM301C4W7D.3.38.D05.1.454.light.4.raw
  modified_base (411)..(411): a, c, t, g, unknown or other
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcaggtggcagtggatctgggacagatttcactctcacatcaacagtctgcaacctgaagattttgcaacttactactntcaacagagtttcactacccctcctctacttcggcggggggtaccgaaggtaggagatacaagaa

SEQ ID NO: 784652 - DNA, 522 bp, Homo sapiens; identical to SEQ ID NO: 725856
  misc_feature: HIJSMM301BJQGS.41.19.B08.1.454.light.4.raw

SEQ ID NO: 784653 - DNA, 483 bp, Homo sapiens
  misc_feature: HIJSMM301BQL4V.43.50.E06.1.454.light.4.raw
  modified_base (476)..(476): a, c, t, g, unknown or other
tgtgagtagtcacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaaccagggaaagtccctgaggtcctcatctatggtgcatccagtttgccaagtggggtcccagcaaggttcagtggcagtggatctgggacagatttcactctcaccatcagcagtctacaacctgaagattttgcaacttactactgtcaacagacgtttcagtacccctctcgacgttcggccaagggaccaaggtcggaaataaacgaactgngctgcac

SEQ ID NO: 784654 - DNA, 468 bp, Homo sapiens
  misc_feature: HIJSMM301AXCEB.4.23.C01.1.454.light.4.raw
  modified_base (460)..(460): a, c, t, g, unknown or other
agcactgtagcacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcttctgtaggagacagagtcaccatcacttgccaggcgagtcaggacattaacaactatttaatttggtatcagcagaaaccaggccatgcccctaggctcctgatctacgatgcatcccatttggaaacaggggtcccatcaaggttcagtggaggtggatatgggacagattttactttcaccatcagcagcctgcagcctgaagatactgcaacatattactgtcaacagtatgataatctgccgctcactttcggacgggagggaccaaggtggagatanaagaagaa

SEQ ID NO: 784655 - DNA, 484 bp, Homo sapiens
  misc_feature: HIJSMM301BZ58Z.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagaatgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctcactttcggcggagggaccagggtggagatcagacgaa

SEQ ID NO: 784656 - DNA, 495 bp, Homo sapiens
  misc_feature: HIJSMM301D22XT.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttgggtttgtcctccatgcaaggtacacactggccttttggccaggggaccaacctcggagagtcaaactgaacgtgtggctgcaccatctgtctt

SEQ ID NO: 784657 - DNA, 505 bp, Homo sapiens; identical to SEQ ID NO: 551816
  misc_feature: HIJSMM301DGNWH.18.78.H01.1.454.light.4.raw

SEQ ID NO: 784658 - DNA, 492 bp, Homo sapiens
  misc_feature: HIJSMM301BUQ0E.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtcctgacaggttcagtggcagtggatcagacacagattttacactgaaaatcagtagagtggaggctgaggatgttggtagtttattactgcgatggcaagctctacaaactcctctcacctttcggcggagggaccaaggtggagtatcaaacgaactgtc

SEQ ID NO: 784659 - DNA, 514 bp, Homo sapiens
  misc_feature: HIJSMM301EE4QU.5.58.F03.1.454.light.4.raw
  modified_base (341)..(341): a, c, t, g, unknown or other
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttcnctggctccaagtctggcaacacggccgccctgacaatctctgggctccaggctgacgacgaggctgatttttactgctgctcatatgcaggtgatcacactttttatgttcgggactgggaccaaggtccaccgtcctaggtcagccaaggccaacccactcgtcactctccg

SEQ ID NO: 784660 - DNA, 488 bp, Homo sapiens
  misc_feature: HIJSMM301DGRLN.51.60.F05.1.454.light.4.raw
cgatcgtatacacgaccggtgctcgatttagtacgtcatcagggaaagggggggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgttgggacagcgacactgccgtgttcggcgggagggaccaagctcgaccgtccgtcggtcagcccaaggctgccccctc

SEQ ID NO: 784661 - DNA, 500 bp, Homo sapiens
  misc_feature: HIJSMM301CWK6Z.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaacgcccccaaactcatcatttatgatgtcagtaatcggccctcagggtttctaatcgcttctctggctccaagtctggcaacacggcctccctgaccatctcgtgggctccaggctgatgacgaggctgattattactgcaggtcataatacaatcagcaacacttatgtcttcgggactggaccaagactcaccgtctaggtcagccaagccaacccactgtc

SEQ ID NO: 784662 - DNA, 520 bp, Homo sapiens
  misc_feature: HIJSMM301EGOKO.51.26.C04.1.454.light.4.raw
cgatcgtatacacgaccggtgctcgatttagtctagcgactttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatccggcctcagggtttcgaatcgcttctctggctccaagtccggcaacacggcctccctgaccatctctggcctccaggccgaggacgaggctgattattactgcagctcatatacaatcaataacaattgggtgttcggcggagggaaccaactcgaccgtcctacggtcacgccgaacggctcgccccctcggtcaccgtctcgtt

SEQ ID NO: 784663 - DNA, 496 bp, Homo sapiens
  misc_feature: HIJSMM301AE6PB.22.73.G07.1.454.light.4.raw
acatacgcgtcacgaccggtgctcgatttagctctacgctcagggggaggaactgctcagttaggacccagacggaaccatggaagcccccagcgcagcttctcttcctcctgctactctggctcccagataccactggagaaatagtgatggacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagatttttgctactttattactgtcagcaatataatgactggttctcgatcaccttcggccaagggacgacgacgtggagattaaacgaaactagtggctgcaccatctcgtt

SEQ ID NO: 784664 - DNA, 496 bp, Homo sapiens
  misc_feature: HIJSMM301BIBDN.52.37.D04.1.454.light.4.raw
cgcagtacgacacgaccggtgctcgatttagtagcatactgttgggtttgggggctgtgggtccaggaggcagaactccgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaggccaaccccactgctac

SEQ ID NO: 784665 - DNA, 491 bp, Homo sapiens
  misc_feature: HIJSMM301BPWD6.41.2.A02.1.454.light.4.raw
tctatactatcacgaccggtgctcgatttagactcatctacaggggagtcccaaccaggacacagcatggacatgaggggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtacaacagtctcatgtctccccttagtttcggcggagggaccaaggttgagatcaaacgaactagtggctgcaccatctgtcttcactcttcccg

SEQ ID NO: 784666 - DNA, 496 bp, Homo sapiens
  misc_feature: HIJSMM301DLNLF.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttattactgtcagctaatattatagttactccgtccgaggctcactttcggcggacgggaccaaggtggagatcaaacgaa

SEQ ID NO: 784667 - DNA, 510 bp, Homo sapiens
  misc_feature: HIJSMM301A87AS.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggtccctcaggggtttctgatcgcttctctggctccaagtctggcaacacggcctccctgacaatctctgggctcaggctgaggacgaggctgattattattgctgctcatatgcaggtagttacacttatgttcttcggaattgggacgacggtcaccggtctacgggtcagcccaacggcccaaccccgta

SEQ ID NO: 784668 - DNA, 508 bp, Homo sapiens
  misc_feature: HIJSMM301E0T8Y.27.78.H01.1.454.light.4.raw
  modified_base (470)..(470): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacattttcacccttcaccatcaataagcctggaagctgaagatgctgcaacttattaactgtcatcagagtactactttaccttcaagtnatcaccttcggccaagggaacacgactgagattaaacg

SEQ ID NO: 784669 - DNA, 503 bp, Homo sapiens
  misc_feature: HIJSMM301EL1II.41.34.D01.1.454.light.4.raw
tctatactatcacgaccggtgctcgatttagatcgtctgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgtattattactgcagctcatatacaagcagcagcactctcgtggtattcggacggagggaccaagctgaccgtcctaggtcagcccgaaggctcccg

SEQ ID NO: 784670 - DNA, 506 bp, Homo sapiens
  misc_feature: HIJSMM301EYQX9.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattagtcagcaggcgcacaatttcccgctcacttcggcggagggaccaaggtggagatcaaacgaactagtggctgcgaccatctgtcttctatctttccccg

SEQ ID NO: 784671 - DNA, 492 bp, Homo sapiens
  misc_feature: HIJSMM301A5SSY.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttggccggacaagtcacggcgttaaaacctatttaaattggtatcagcagaaacctggaaaagccccagacctcctgatctctggtgcatccactctgcgaagtggcgtcccatcgaggttcagtgcagtggatctgggacagatttcaatctcaccatcaccactctgcaacctgagattgtgcaatctactactgtcaacagagttacacgttcccctcgcacttttggtccgaggggaccaaagttagagatacaaacgaactagtggctgcaccatctgtt

SEQ ID NO: 784672 - DNA, 513 bp, Homo sapiens
  misc_feature: HIJSMM301EWHJL.43.23.C01.1.454.light.4.raw
  modified_base (475)..(475): a, c, t, g, unknown or other
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcggcggtgggtgttcggcggaggaccaagctgaccgtctgggtcngcccaggctcgccccctcggcactctgttccccaccct

SEQ ID NO: 784673 - DNA, 498 bp, Homo sapiens
  misc_feature: HIJSMM301D9V0L.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactattatgtcaagcagtagacagcagtggtccttatcgggtgttcggcgggggaccaagctgaccgtccgtaggtcagccaaggctcgcccctcggtctac

SEQ ID NO: 784674 - DNA, 493 bp, Homo sapiens
  misc_feature: HIJSMM301CD9ZJ.4.27.C05.1.454.light.4.raw
agcactgtagcacgaccggtgctcgatttagacgcgatcgaagggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagaggtggaggctgaggatggttgggtttactactgcatgcaagctctacaagccacctactacttttcggccgtacggggaccgaggcgtggagatacaaacgaac

SEQ ID NO: 784675 - DNA, 523 bp, Homo sapiens
  misc_feature: HIJSMM301E38JO.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggttggtgctgtgctattcgggccggagggaccaagctgaccgtcttaagtacagcccaaggctcgccccctcggtccactctcgttcccaccctccctcc

SEQ ID NO: 784676 - DNA, 493 bp, Homo sapiens
  misc_feature: HIJSMM301D6TK5.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacacctattggtacttatgtcttcggaatgcgaccaggtcaccgtcctgggtcagcccaaggccaacccactgt

SEQ ID NO: 784677 - DNA, 485 bp, Homo sapiens
  misc_feature: HIJSMM301A3JWV.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccgcctccgtggacattcggccaaggtaccaaggtggacatcagacgaactgtggctgcacc

SEQ ID NO: 784678 - DNA, 510 bp, Homo sapiens
  misc_feature: HIJSMM301AQXO0.46.35.D02.1.454.light.4.raw
actagcagtacacgaccggtgctcgatttagcacacgatagttgggtttgggggagctgctcagttaggacccagagggaaccatggaaacccccagcgcagcttctcttcctcctgctactctggctcccagaaaccaccggagaagttgtgttgacgcagtctccaggtttttcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtagtggtccacgtacccaagtaacttttcggaccgaggggaccaagctggagactacaaacgaactggtcggctcgcaccatcttcg

SEQ ID NO: 784679 - DNA, 505 bp, Homo sapiens
  misc_feature: HIJSMM301A88UN.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcacggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcacgcccaaggctcgccccctcc

SEQ ID NO: 784680 - DNA, 492 bp, Homo sapiens; identical to SEQ ID NO: 566665
  misc_feature: HIJSMM301BSG16.26.78.H01.1.454.light.4.raw

SEQ ID NO: 784681 - DNA, 497 bp, Homo sapiens
  misc_feature: HIJSMM301ALL6D.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtgtcagtgggtctgggacagacttcactctcaccatcagcagactggagcctagaagattttgcagtgtattactgttcagcagtatggtagctcacctcggacgttcggccagggaccgaaggtaggaaagtacaaacgaactagtacggtcgtcgcgacca

SEQ ID NO: 784682 - DNA, 544 bp, Homo sapiens
  misc_feature: HIJSMM301AVPNU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaacagttttctcgggtcgttcggtccgacgggaaccgtaacggtagggaaattacgaaaacgtaaaccgtaggtagggcttagaccgacccaactcctggttccttctaacttccttttcccccc

SEQ ID NO: 784683 - DNA, 486 bp, Homo sapiens
  misc_feature: HIJSMM301B8E5D.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtacaacagtatcataatctccccactttccggcctgggaccaagtggatatcaaacgaactgtggctgcaccatctgtt

SEQ ID NO: 784684 - DNA, 495 bp, Homo sapiens
  misc_feature: HIJSMM301EA698.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactatgctgctcatatgcaggtcgtatctcttatgtcttcggaactgggaccaaggtcacgtcctaggtcagcccaaggcccaaccca

SEQ ID NO: 784685 - DNA, 477 bp, Homo sapiens
  misc_feature: HIJSMM301AQ7GY.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaagctcctgatctatgctgcatccagtttgcaaagtgggtcccatcaaggttcagtggcagtggatctgggacagatttcactctcaccatcaacagtctgcaacctgaagattttgctaacttactactgtcaacagatttcacctacccctctcactttcggcgggggaccgaaggtggagagtcaaacgaactgtgg

SEQ ID NO: 784686 - DNA, 524 bp, Homo sapiens
  misc_feature: HIJSMM301C2YNM.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttggggtgttcgggcggagggaccaaaacgtgaccgtcctaggtcgagcccaaggctcgcccccgtcggtccactctccg

SEQ ID NO: 784687 - DNA, 502 bp, Homo sapiens
  misc_feature: HIJSMM301CO35M.48.2.A02.1.454.light.4.raw
agtatacatacacgaccggtgctcgatttagactcatctacagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccagtcagcaccctgcagcctgaagattttgcgtacttatttcctgtctactaagattactaattaccctcggaccgttcggtcctacgggaccgaacggtaggaggtagttcgaaccgtaacctaggtcggtcgtcggta

SEQ ID NO: 784688 - DNA, 531 bp, Homo sapiens
  misc_feature: HIJSMM301DCX0K.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagctactttgggtggtttcgggcggcggggaccaaaggtgaccgtcctaagtcagcccaaggcctgccccctcggtcactctcgttcccaccctt

SEQ ID NO: 784689 - DNA, 514 bp, Homo sapiens
  misc_feature: HIJSMM301B7YQ8.8.28.C06.1.454.light.4.raw
ctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactgggccgttctacgtttcggcggagggaccgaaggtggaccctcaaacgaactgtggctgcaccatctagtcttcatccttcccgcc

SEQ ID NO: 784690 - DNA, 343 bp, Homo sapiens
  misc_feature: HIJSMM301DQBIK.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagactaccaaccggagaaactgtgttgacacagtctccaggcaccctgtctttgtcgtccggggaaagagccaccctctcctgcagggccagtcagagtcgttagcatatatttacgcctggtaccaacagaaacctggccaggtctcccaggcctcctacatcaaaggtgcgatcccacgaaggccaacgtggcactcccagacacggttcc

SEQ ID NO: 784691 - DNA, 520 bp, Homo sapiens
  misc_feature: HIJSMM301AW97Y.3.87.H10.1.454.light.4.raw
agacgcactccacgaccggtgctcgatttagcagtactgcgttgggtttgggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgctttctggctccaagtctggcaacacggcctccctgaccatctctgggctcccaggctgaggacgaggctgattatttctgcagctcatacacaaccggcaccactgtcgtggttttcggtggagggaccaagctgaccgtcctaggtcagcccaaggctgccccctcggtcacttc

SEQ ID NO: 784692 - DNA, 492 bp, Homo sapiens
  misc_feature: HIJSMM301BVMPE.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatatggattggtacctgcagaagccaggggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctactacaactccctacacgttcggcggagggaccgaaggtggagatcaaacgaactgtggctgcaccatctgtctt

SEQ ID NO: 784693 - DNA, 503 bp, Homo sapiens
  misc_feature: HIJSMM301AS9O4.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgccctccaagtccggcacctcagcctccctggccatcagtgggctccgggccgaggatgaggctgattattactgtgcaggatgggatgacaacgtgggtgcttatcttcttcggaccttgggaccaaggtcaccgtcctt

SEQ ID NO: 784694 - DNA, 472 bp, Homo sapiens
  misc_feature: HIJSMM301CZ4LK.40.59.F04.1.454.light.4.raw
tctagcgactcacgaccggtgctcgatttagtacacacacttagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtggacatcagcagtgaggtggttttcggcggaggaccgaagctgaccgtctagtcagccc

SEQ ID NO: 784695 - DNA, 513 bp, Homo sapiens
  misc_feature: HIJSMM301DBBVG.15.86.H09.1.454.light.4.raw
tctacgtagccacgaccggtgctcgatttagtgctatagacttgggtttggggtccacgtgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgacctacaccatcgaatggtatcaacagagaccaggggaacgtccccccagtatataatgaaagttaagagtgatggcagccacaccgaagggggacgggatccccgatcgcttcatgggctccagttctggggctgaccgctacctcaccatctccaacctccagtctgacgatgaggctgagtatcactgtggagagagccacacaattgatggccaggacggttgggtgttcgggcggagggaccaagctgacccgtcctaggtcaccg

SEQ ID NO: 784696 - DNA, 517 bp, Homo sapiens
  misc_feature: HIJSMM301A3ASU.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcgttgggcaactactgtcgtttgggttggttcggcgggagggaccaagttgaccgtcctaggtcagcccaaggctcgccccctcggtccacttctcgtt

SEQ ID NO: 784697 - DNA, 494 bp, Homo sapiens
  misc_feature: HIJSMM301EC42C.51.81.H04.1.454.light.4.raw
  modified_base (395)..(395): a, c, t, g, unknown or other
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccgaggtcagggacaacggtcacattggccatcagtggagtccaggcagaggacgagctgactnttattgtcaatcaacagacaccattggtacttatgtcttcggaatgcgacaggtcaccgtcctgggtcagcccaaggccaaccccactcgtcactctcg

SEQ ID NO: 784698 - DNA, 498 bp, Homo sapiens
  misc_feature: HIJSMM301A2UF5.10.68.G02.1.454.light.4.raw
catagtagtgcacgaccggtgctcgattagtcgatagtgaagggaaaggggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccagggggtcgatgaggctgactactactgtttctcgactgacttcactggtaaacgttggctgttcggcggagggaccaagctgaccgtcctgcgtcagccaaggctgcccctcgtcactc

SEQ ID NO: 784699 - DNA, 486 bp, Homo sapiens
  misc_feature: HIJSMM301D42XU.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggctccctgacaatctctgggctccaggctgacgacgaggctaattattactgctgctcatatgaaggttataacactatactattcggtcggagggaccaagctgaccgtcctgcgtcagcccaaggctgccccctcggtcactcctgttcccaccctcctcgctacgtaga

SEQ ID NO: 784700 - DNA, 516 bp, Homo sapiens
  misc_feature: HIJSMM301CCDY5.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcgaggggtttctaatcgcttctctggctccaagtctggcaacacggcctccctgaccatctctgggctccaggctgaggacgaggctgattattactgcagctcatatacaagcacagcactctctatgtcttcggaactgggaccaaggtccaccgtcctaggtcacgcccgaacggcccaacccccacttcgta

SEQ ID NO: 784701 - DNA, 517 bp, Homo sapiens
  misc_feature: HIJSMM301D3KI0.9.12.B01.1.454.light.4.raw
  modified_base (486)..(486): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcggggtcgttcggtaccaagggaccaaggtacggaaagtacaaacgaactagtggngtgcaccatctgtcttctacttacctccccg

SEQ ID NO: 784702 - DNA, 498 bp, Homo sapiens; identical to SEQ ID NO: 535295
  misc_feature: HIJSMM301CHM6Y.15.25.C03.1.454.light.4.raw

SEQ ID NO: 784703 - DNA, 507 bp, Homo sapiens
  misc_feature: HIJSMM301CQ59B.48.26.C04.1.454.light.4.raw
agtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaattgtggtattcggacggagggaccaagctgaccgtctaggtcagcccaaggctcgccccctcggta

SEQ ID NO: 784704 - DNA, 505 bp, Homo sapiens
  misc_feature: HIJSMM301BHWWF.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacacccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtactttcggcggaggaccaagctgaccgtcctgggtcagcccaaggcctcgccccctcggtctacc

SEQ ID NO: 784705 - DNA, 513 bp, Homo sapiens
  misc_feature: HIJSMM301BDAJ0.3.27.C05.1.454.light.4.raw
agacgcactccacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgaccccagtccccagactccctggctgtgtctctgggcgagagggccaccatcaactgcaagtccagccagagtgttttatacagctccgacaataagaactacttagtcttggtaccagcagaaaccaggacagcctcctaaactgctcatttactgggcatctacccgggaatcccggggcccctcgaccgattcaatggcagcgggtctggggcagatttcactctcaccatcagcagcctgcaggctgaagatgtggctagtttattactgtcagcaatattatactcctcttccgtacgttccggccaacgggaccgaaggtaggaaatacaaacgaaactgtggctgacaccat

SEQ ID NO: 784706 - DNA, 511 bp, Homo sapiens
  misc_feature: HIJSMM301D8N8Q.22.21.B10.1.454.light.4.raw
acatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctggctccaggctgaggatgaggctgattattactgctactcatatgcaggcggcaactcttgggtgttcggcggagggaccaagctgaccgtcctaggtccagcccaaggcctcgccccctcggtccactcttccg

SEQ ID NO: 784707 - DNA, 518 bp, Homo sapiens
  misc_feature: HIJSMM301DWV7T.14.19.B08.1.454.light.4.raw
  modified_base (180)..(180): a, c, t, g, unknown or other
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggnagagggtcaccatctcttgttctggaagcagctccaaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagctgagtggtccttgggtgttcggcgggagggaccaagctgaccgtcctaagtcagcccaaggctgccccctcggtcacgtctgttcccaccctcctccg

SEQ ID NO: 784708 - DNA, 481 bp, Homo sapiens
  misc_feature: HIJSMM301DKX3E.16.86.H09.1.454.light.4.raw
  modified_base (475)..(475): a, c, t, g, unknown or other
tgtactactccacgaccggtgctcgatttagtgctatagacttggggtttgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgagggctgattattattgcatctcataatacaaccaacagcactctcgactggtattcggcggagggaccaagctgaccgtcctaggtcagcccaaggcctgccccctcggtcactctcgttcccacctcctcanagtaca

SEQ ID NO: 784709 - DNA, 500 bp, Homo sapiens; identical to SEQ ID NO: 636792
  misc_feature: HIJSMM301AD3GA.48.59.F04.1.454.light.4.raw

SEQ ID NO: 784710 - DNA, 491 bp, Homo sapiens
  misc_feature: HIJSMM301DVW4L.41.12.B01.1.454.light.4.raw
tctatactatcacgaccggtgctcgatttagtagtgtagattccgcggggaggaatcagacccagtcaggacacagcatggacatgagagtcctcgctcagctcctggggctcctgctgctctgtttcccaggtgccagatgtgacatccagatgacccagtctccgtcctcactgtctgcatctgtgggagacagagtcaccatcactttgtcgggcgagtcaggacattagcaattatttagcctggtttcagcagaaacccggcaacgcccctaaatccctaatctatgctgcatccactttgcgaagtggggtcccgtcaaagttcagcggcggcagatctgggacagacttcactctcaccatcagcaacctgcagcctgaagattttgcaacttattactgccaacaatacagcacgtttcccctcactttcggcggagggtaccacgggtggagatcaaacgaactgtggctgcaccatcttcg

SEQ ID NO: 784711 - DNA, 460 bp, Homo sapiens; identical to SEQ ID NO: 537107
  misc_feature: HIJSMM301ALVJF.22.28.C06.1.454.light.4.raw

SEQ ID NO: 784712 - DNA, 528 bp, Homo sapiens
  misc_feature: HIJSMM301D8WS0.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtccgtaggtcagcccaaggctcgccccctcggtcactctcgttcccaccctccc

SEQ ID NO: 784713 - DNA, 506 bp, Homo sapiens
  misc_feature: HIJSMM301CYYYW.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctcaggctgaggacgaggctgcttattactgcagctcatatacaaggagcaccactctcgtggttatttgggtggagggaccaagctgaccgtctagtcagcccaaggctcgcccctcggt

SEQ ID NO: 784714 - DNA, 519 bp, Homo sapiens
  misc_feature: HIJSMM301ELVCO.7.34.D01.1.454.light.4.raw
cgtgtctctacacgaccggtgctcgatttagatcgtctgtgttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactagctgctcatatacaggggacagcattatttgggttgttcggcggagggaccaaggctggaccgtcctgcgtcagcccaaggcctcgccccctcggtcacgt

SEQ ID NO: 784715 - DNA, 513 bp, Homo sapiens
  misc_feature: HIJSMM301ALPH1.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcaggcgggtcagggacagtattttacactagaaaatcaggccgggtggaggctgaggacgttggtaatttattactgtatgcgaaggtatagagtcttcctccgaccgttcggaccgaagggaaccgaaggtaggaactacgaaacgaagtcgtggctga

SEQ ID NO: 784716 - DNA, 522 bp, Homo sapiens
  misc_feature: HIJSMM301B16X1.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactcttactttggtggtgctgtgctagttcggcggagggaccaagctgaccgtcttaagtcagcccaaggctcggccccctcggtcactctcgttcccaccctcctccc

SEQ ID NO: 784717 - DNA, 519 bp, Homo sapiens
  misc_feature: HIJSMM301D56E0.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaatacccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggtttatagcacttgggtgttcggcggcgggaccaagtgaccgtcctaagtcagccaaggctcgcccctcggtcactctgttcccgccct

SEQ ID NO: 784718 - DNA, 522 bp, Homo sapiens
  misc_feature: HIJSMM301DSY8P.41.87.H10.1.454.light.4.raw
  modified_base (480)..(480): a, c, t, g, unknown or other
tctatactatcacgaccggtgctcgatttagcagtactgcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtccngggtcagcccaaggctcgccccctcggtcactctgttcccgt

SEQ ID NO: 784719 - DNA, 510 bp, Homo sapiens; identical to SEQ ID NO: 627345
  misc_feature: HIJSMM301DFNQP.19.78.H01.1.454.light.4.raw

SEQ ID NO: 784720 - DNA, 498 bp, Homo sapiens
  misc_feature: HIJSMM301ADX5M.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtactacttttggccgaggggaccaaggctgggagatcaaacgaactgtggctgcaccatct

SEQ ID NO: 784721 - DNA, 494 bp, Homo sapiens
  misc_feature: HIJSMM301BORGS.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagtattttgctagtttattactgtcagcactataataactggcctccgtactagttttggccgacggggaccaaggctgggagatacaaacgaactgtgg

SEQ ID NO: 784722 - DNA, 516 bp, Homo sapiens
  misc_feature: HIJSMM301AE0IX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctcctaaactgctcattaactgggcatctacccggcaatccggggtccctgaccgattcagtggcagcgggtctgggatagatttcactctcaccatcagcagcctgcaggctgaagatgtggcagtttattactgtcaacagttttctcgggcgtcgtccgaacgggaccgaaggtaggaaagtaacaaacgtaaactagtggcgtgcaccatactgttcttcctatccttccccg

SEQ ID NO: 784723 - DNA, 515 bp, Homo sapiens
  misc_feature: HIJSMM301CK66E.22.30.C08.1.454.light.4.raw
  modified_base (512)..(512): a, c, t, g, unknown or other
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaaggggtcgggatccctgatcgcttctcgggctccagctctggggccgagcgctacctcaccatctccagcctccagtctgaagatgaggctgactattactgtcagacatgggacgctggcgtctggctgttcggcggagggccaagctgaccgtcctaggtcaggccaaggctgcccctcggtcactctgtcccgcctcctacnccg

SEQ ID NO: 784724 - DNA, 526 bp, Homo sapiens
  misc_feature: HIJSMM301AUJ7W.7.34.D01.1.454.light.4.raw
cgtgtctctacacgaccggtgctcgatttagatcgtctgtgttgggtttgggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgtcttctctggctccaagtctggcaacacggcctccctgaccatctctggactccagactgaggacgaggctgattattactgctgctcatatacgaggggacaggcatttatttgggttgttcgggcgggagggaaccgaagctggaccgtccctgcgtcagcccaaggctcgccccctcggtccactc

SEQ ID NO: 784725 - DNA, 492 bp, Homo sapiens
  misc_feature: HIJSMM301DHK57.41.72.G06.1.454.light.4.raw
tctatactatcacgaccggtgctcgatttagctacgactgcaagggaaaggggtccaaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggaccgaggctgactattactgctcagcatgggacagcagcctcacaaattggatgtcggcggaggaccaagctgaccgtcctaggtcagcccaac

SEQ ID NO: 784726 - DNA, 511 bp, Homo sapiens
  misc_feature: HIJSMM301BHV4I.19.59.F04.1.454.light.4.raw
  modified_base (243)..(243): a, c, t, g, unknown or other
tactctcgtgcacgaccggtgctcgatttagtacacacacttagggattggggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgngtcctggtaccagcagctcccaggaacagcccccaaactcctcatttttgacaataataagcgaccctcagggattcctgaccgattctctggctccaagtctggcacgtcagccacctgggcatcaccggactccagactggggacgaggccgattattactgcggaacatgggatagcagcctgagtactgtgataatcgcgggagggaccaaggctgaccgtcctaggtcagcccaaggctgccccctggtcactctgttcccta

SEQ ID NO: 784727 - DNA, 511 bp, Homo sapiens
  misc_feature: HIJSMM301AFHCK.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcgggagggaccaagctgaccgtcctgcgtcacggcccaaggcctcggccccctcggtccacttcc

SEQ ID NO: 784728 - DNA, 515 bp, Homo sapiens
  misc_feature: HIJSMM301C16RM.40.81.H04.1.454.light.4.raw
tctagcgactcacgaccggtgctcgatttagtagtgtagattcgcgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaactaattgggtcttcgggcggagggaccaagctggaccgtcctaggtcagcccaaggctcgccccctcggtcactctcg

SEQ ID NO: 784729 - DNA, 512 bp, Homo sapiens
  misc_feature: HIJSMM301BQYMY.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagcctgaccgtcttaaggtcagcccaaggctgccccctcggtcactctgtcccta

SEQ ID NO: 784730 - DNA, 483 bp, Homo sapiens
  misc_feature: HIJSMM301DN8AI.17.26.C04.1.454.light.4.raw
cgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgctaacttactactgtcaacagtagttacaactacccctcggctcactttcggcggagggaccaaggtggagatacaaacgaactagtgg

SEQ ID NO: 784731 - DNA, 546 bp, Homo sapiens
  misc_feature: HIJSMM301AUZ11.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgagggctgattattattgtagtttcatatacaaccacgtgacacttgggtggttcggcggaggggaccgaaggctgaccggtcctaggtcagcccaacggcttgccccccgttccggtcgtacctcctcgtttcccgaccccctt

SEQ ID NO: 784732 - DNA, 515 bp, Homo sapiens
  misc_feature: HIJSMM301EXUYS.22.21.B10.1.454.light.4.raw
  modified_base (336)..(336): a, c, t, g, unknown or other
acatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctntggctccaagtctggcgacacggcctccctgaccgtctctgggctccaggctgaggatgaggctgatttattactgctactcatatgcaggcggcaactcttgggtgttcggcggagggaccaagctgaccgtcctaggtccagcccgaaggcctgcccccctcggtcctactcttccg

SEQ ID NO: 784733 - DNA, 527 bp, Homo sapiens
  misc_feature: HIJSMM301AP1G4.41.19.B08.1.454.light.4.raw
tctatactatcacgaccggtgctcgatttagtgagtcagtaagggggctgggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggcctcaggggtttctaatcgcttctctggctccaagtccggcgacacggcctccctgaccatctccccggcctccaggcggaggacgagggtgattatttctgcagctcatttacaaccagccacaccttgctcttcggaactgggaccacggtcatcgtcctaggtcagcccaaggcccaaccccactagtccactctcgttcccaccctccta

SEQ ID NO: 784734 - DNA, 511 bp, Homo sapiens
  misc_feature: HIJSMM301AJDJX.12.67.G01.1.454.light.4.raw
  modified_base (449)..(449): a, c, t, g, unknown or other
atacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcgaggggtttctgatcgcttctctggctccaagtctgactacacggcctccctgaccatctctgggctccaggctggaggacgaggctgattattattgcagctcatatacaagcagcagcctaccctntttcgtcttcggaagtcgggaccaacggtcaccgtcctacgtcacgcccaaggcccaacccc

SEQ ID NO: 784735 - DNA, 528 bp, Homo sapiens
  misc_feature: HIJSMM301AWMLX.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcacgcagtcccccatgtgagtccgtttcgggccggggggaccgaaggcctacgaccgtcctagggtcctaggcccaaggcctcggtccccccc

SEQ ID NO: 784736 - DNA, 507 bp, Homo sapiens
  misc_feature: HIJSMM301BBFV8.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgtatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcttcgtggtattcgggcggagggaccaagctcgaccgtcctaggtccagcccaaggctcccgg

SEQ ID NO: 784737 - DNA, 521 bp, Homo sapiens
  misc_feature: HIJSMM301BCYS4.47.83.H06.1.454.light.4.raw
  modified_base (371)..(371): a, c, t, g, unknown or other
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttcnctggttccatccttgggaacaaagctgccctcaccatcgcgggggcccaggcagatgatgagtgtgattattactgtgtgctctatagtgggtcgaggtggcggttttcgggtgggtttcggcgggagggaccgaaggctcgaccgttcg

SEQ ID NO: 784738 - DNA, 501 bp, Homo sapiens
  misc_feature: HIJSMM301B1YGX.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagccaaggctgccccctcggtcactc

SEQ ID NO: 784739 - DNA, 496 bp, Homo sapiens
  misc_feature: HIJSMM301AMZNB.46.35.D02.1.454.light.4.raw
actagcagtacacgaccggtgctcgatttagcacacgatagttgggtttggggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctatttactgtcagctagtatggtcacgtcccaagtaacttttcggccgtaggggaccaagctggagatacaaacgaactgtggctgccaccat

SEQ ID NO: 784740 - DNA, 497 bp, Homo sapiens
  misc_feature: HIJSMM301DNWF7.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcaggggtttctaatcgcttctctggctccaagtctggcaacacggcctccctgaccatctctggctccaggctgaggacgaggctgattattactgcagctcatatacaagcaccagcactctctatgtcttcggaactgggaccaaggtcaccgtcctaggtcacgcccaagga

SEQ ID NO: 784741 - DNA, 498 bp, Homo sapiens; identical to SEQ ID NO: 535914
  misc_feature: HIJSMM301BKS98.18.59.F04.1.454.light.4.raw

SEQ ID NO: 784742 - DNA, 512 bp, Homo sapiens
  misc_feature: HIJSMM301AZEOL.15.59.F04.1.454.light.4.raw
tctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatcttgtttattattgtgtcctatatatgggtgctggctatttcggtcttcggcggagggaccaagctgacccgtcctaggtcacgcccaaggctcgccccctcggt

SEQ ID NO: 784743 - DNA, 500 bp, Homo sapiens
  misc_feature: HIJSMM301BM3HH.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgcact

SEQ ID NO: 784744 - DNA, 499 bp, Homo sapiens
  misc_feature: HIJSMM301A7RAZ.41.35.D02.1.454.light.4.raw
tctatactatcacgaccggtgctcgatttagcacacgatagttgggtttggggggggtcacaagaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctccg

SEQ ID NO: 784745 - DNA, 493 bp, Homo sapiens
  misc_feature: HIJSMM301B602D.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtcggagatcaaacgaactgtggctgcaccatctgtcttcatcttcccgccat

SEQ ID NO: 784746 - DNA, 490 bp, Homo sapiens
  misc_feature: HIJSMM301DWEJM.14.55.E11.1.454.light.4.raw
  modified_base (457)..(457): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgacaacttactactgtcaacagagttacacgtacccccctctactttcggcggagggaccaaggcgganatcagacgaactgtgctgcaccatctgtctcta

SEQ ID NO: 784747 - DNA, 514 bp, Homo sapiens
  misc_feature: HIJSMM301BEHCW.51.53.E09.1.454.light.4.raw
cgatcgtatacacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgatttattactgcagctcatatacaaacagaaacacttgggtgttcggcggcggaccaaactgaccgtcctacgtcagcccaaggctcgccccctcggtccactt

SEQ ID NO: 784748 - DNA, 493 bp, Homo sapiens
  misc_feature: HIJSMM301BJRTW.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacaggggactccggggtcccagacagattcagcggcagtgggtcaggcactgatttcacactagaaatcagcgagggtggaggcgtgaggatgttattgggcttctattattgcatgcaagcaacacactggccgtacacttttggcctagggaccgaagctggagatcaatcgaact

SEQ ID NO: 784749 - DNA, 504 bp, Homo sapiens
  misc_feature: HIJSMM301C6VKQ.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggccccctgtgttggtgatgtataaagacagtgagaggccctcaggggatccctgagcgattctctggcgccaggctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactctcg

SEQ ID NO: 784750 - DNA, 480 bp, Homo sapiens
  misc_feature: HIJSMM301A21W1.48.5.A05.1.454.light.4.raw
agtatacatacacgaccggtgctcgatttagatagatagacagggggcaggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgcaacagtattatacttatccatggacgttcggccaagggaccaaggtggaaatcaaacgaactgtggctgcaccta

SEQ ID NO: 784751 - DNA, 529 bp, Homo sapiens
  misc_feature: HIJSMM301DS4O5.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgctttataattttgtcgcctggtaccaacaacaccccggcgaagcccccagactcataatttatgatgtcactgatcggccctcaggggtttctaatcgcttctctggctccaagtccggcgacacggcctccctgaccatcctccggcctcccaaggcggaggacgagggtgattatttctgccagctcatttacaaccagccacaccttgctcttcggaactggaccacggtccatcgtcctaggtcagcccaacggccaaccccactcgtcactctcgttcccgccctccta

SEQ ID NO: 784752 - DNA, 487 bp, Homo sapiens
  misc_feature: HIJSMM301B3J9M.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccagggttccgcgaacacagcctccctgaccatcactggactcaagcctgaggacgaggctgactattactgttcagcatgggacggcagcctcagtgaatgggtgtcggcggagggaccaaacgtcgtccggtcctaggtccag

SEQ ID NO: 784753 - DNA, 516 bp, Homo sapiens
  misc_feature: HIJSMM301B8O3V.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgctctctggttccatccttggaacaaagctgccctcaccatcggcgggggcccaggcagatgatgagtgtgtattattactgtgtgctctatatggcaggtggtcggtttgggttggttcgggtcggacgggaccaaggcctgaccgttcg

SEQ ID NO: 784754 - DNA, 496 bp, Homo sapiens
  misc_feature: HIJSMM301D0EDQ.14.53.E09.1.454.light.4.raw
cgtctagtaccacgaccggtgctcgatttagagagagtgtgttgggtttgggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgtcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttagtcggtgttcggcggagggaccaagctgaccgtcctaggtcagcccaaggctcgccccctcggt

SEQ ID NO: 784755 - DNA, 525 bp, Homo sapiens
  misc_feature: HIJSMM301BW3HD.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcggcggagggaccgaggctgaccgtcctaggtcagcccaaggctcgccccctcggtccactctcgttcccaccctt

SEQ ID NO: 784756 - DNA, 508 bp, Homo sapiens
  misc_feature: HIJSMM301AG5KT.27.78.H01.1.454.light.4.raw
agcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatccagagtactactttacctcaagtgatccaccttcggccaagggaccacgactggagaattaaacg

SEQ ID NO: 784757 - DNA, 528 bp, Homo sapiens
  misc_feature: HIJSMM301EQX1U.40.62.F07.1.454.light.4.raw
  modified_base (411)..(411): a, c, t, g, unknown or other
tctagcgactcacgaccggtgctcgatttagtagtcgcataaagggaaagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggctgcagtctgatggatttgcaacttatttctgccaanagtatactattaacttctttactccggaaccttcggtccgaacgggaccgtaaggggtggtaaaagttaccgaaaacgaaacctaaggtggtcgcgacgaaccactacttcgtcttt

SEQ ID NO: 784758 - DNA, 520 bp, Homo sapiens
  misc_feature: HIJSMM301B7DPC.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattaatctggtgcgtctatatgggtacaggtggcgtttggggtggtttcggcgggagggaccgaagacgtgtaccgttcg

SEQ ID NO: 784759 - DNA, 501 bp, Homo sapiens
  misc_feature: HIJSMM301DARWI.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactaacttagcttggtaccagcagagaccaaggacagcctcctaggctgctcatttactgggcatctacccgggaatccggggtccctgaccgattcagtggcagcgggtctgggacagatttcactctcaccatcagcagcctgcaggctgaagatggtggcagttttattattgtacaacaattattaattattacttcggtggacgttcgccgaaggaccgaaggttaggatatactacgacgaaa

SEQ ID NO: 784760 - DNA, 521 bp, Homo sapiens
  misc_feature: HIJSMM301D3SCQ.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgagctgattacttctgttgcttcgttgggcaactactgttcgtttggggtgttcgggcggagggaccaaggttcgaccggtctaggtcacggcccaaggctcgccccctcggtcacctcttcgtt

SEQ ID NO: 784761 - DNA, 502 bp, Homo sapiens
  misc_feature: HIJSMM301EDIIC.21.81.H04.1.454.light.4.raw
  modified_base (499)..(499): a, c, t, g, unknown or other
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaaacacttatgtcttcgggactgggaccaagatcaccgtcctaggtcagcccaaggccaacccactntca

SEQ ID NO: 784762 - DNA, 509 bp, Homo sapiens
  misc_feature: HIJSMM301A81MX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacagttttctcgggcgttgccgaggaccgaacggtggaaatacaaacgaactagtggtactgcaccaatctcgtcttctatcttccccg

SEQ ID NO: 784763 - DNA, 525 bp, Homo sapiens
  misc_feature: HIJSMM301ALSUI.48.14.B03.1.454.light.4.raw
agtatacatacacgaccggtgctcgatttagtgtgagtagttccgcggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaactatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctggaggatgttggcacttattactgcatgcaaggctcacactggcctccgtggacgtcgtccgaacgggacccgggtaggaaataaaacgaaacgtagtaggctcgcaccgactacctgtcttctac

SEQ ID NO: 784764 - DNA, 508 bp, Homo sapiens; identical to SEQ ID NO: 544615
  misc_feature: HIJSMM301CXYT2.47.85.H08.1.454.light.4.raw

SEQ ID NO: 784765 - DNA, 512 bp, Homo sapiens
  misc_feature: HIJSMM301ARKBA.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgactcatatgcaggtcgtatctcttatgtcttcggaactgggaccaaggtcacccgtctaggtcagcccaacggcccaaccccactgtctacc

SEQ ID NO: 784766 - DNA, 489 bp, Homo sapiens
  misc_feature: HIJSMM301A86ZV.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtcccaagtaacttttggccagggaccagctggagatacaacgactgtggctgcacatcttcg

SEQ ID NO: 784767 - DNA, 450 bp, Homo sapiens
  misc_feature: HIJSMM301CIRFB.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagccctccctggccatcactggggcttcaggctgaggatgaggctgattattactgccactcctatgacagcagcctgagaagtgtggtattcggcggagggaccaagctgaccgtcctaggtcagcccaaggctcgccccctcggtccactctcgttcccgccctacctcagacgtatca

SEQ ID NO: 784768 - DNA, 490 bp, Homo sapiens
  misc_feature: HIJSMM301A1RPK.19.21.B10.1.454.light.4.raw
  modified_base (262)..(262): a, c, t, g, unknown or other
tactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagnttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattattacttcgtggacgttcggccgaagggaccgaaggtaggatatcagacga

SEQ ID NO: 784769 - DNA, 447 bp, Homo sapiens; identical to SEQ ID NO: 535201
  misc_feature: HIJSMM301CDUOH.18.9.A09.1.454.light.4.raw

SEQ ID NO: 784770 - DNA, 509 bp, Homo sapiens
  misc_feature: HIJSMM301CD8HO.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcgccaagggaccaaggtggaagtcaagcgaactgtggctggcaccatctgtcttctatcttcccgcc

SEQ ID NO: 784771 - DNA, 490 bp, Homo sapiens
  misc_feature: HIJSMM301CIJY9.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaagagccaccctctcctacagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagtactttggccagggaccaagctggagatcaaacgaactggtgctcgcaccatctgtt

SEQ ID NO: 784772 - DNA, 490 bp, Homo sapiens
  misc_feature: HIJSMM301EQKIE.40.52.E08.1.454.light.4.raw
tctagcgactcacgaccggtgctcgatttagtcgagctctcagagagaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaactagcagtgacattggtgcttataactatgtctcctggtaccaacaacacccaggcgaggcccccaaactcatgatttatgatgtcaataatcggccctcaggggtttctaatcgcttctctggctccaagtctggcaacacggcctccctgaccatctctgggctccaagctgaggacgaggctgtttatttctgcagctcatatacaagcagcaacactctggtgttcggcggagggaccaagctcgaccgtcctgagtcagccc

SEQ ID NO: 784773 - DNA, 498 bp, Homo sapiens
  misc_feature: HIJSMM301A4PQS.41.53.E09.1.454.light.4.raw
tctatactatcacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattatactgcagctcatatacaagcagcagcactctcgtggtattcggcggagggaccaagctgaccgtctaggtcagcccaaggctccg

SEQ ID NO: 784774 - DNA, 513 bp, Homo sapiens
  misc_feature: HIJSMM301EA60B.5.86.H09.1.454.light.4.raw
atcagacacgcacgaccggtgctcgatttagtgctatagacttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggcctcaggggtccctgatcgcttctctggctccaagtctggcaacacggcctccctgaccgtctctgggctccagactgaggatgaggctgactattactgcagctcatttgcaggcagccgtatacctcttcggcggacgggaccaaggctgaccgtcctaggtcacgcccaaggctcgcccccgtcggtcctacc

SEQ ID NO: 784775 - DNA, 511 bp, Homo sapiens
  misc_feature: HIJSMM301DIHJT.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctggggctccgaggctgagggacgaggctgtattattacctgcagctcatatacaagcagcagcactcaagtcttcgggaactgggaccaaggtcaccgtcctaggtcagcccaaggcccaacccactgt

SEQ ID NO: 784776 - DNA, 492 bp, Homo sapiens
  misc_feature: HIJSMM301DVH0R.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattgggttctaatcgggcctccgggtccctaacaggttcagtggcagtggatcaggcacagattttacactgaaaatcagcagagtggaggctgaggatgttggggtttattactgcatgcaagctctacaacctctgcggacttcggccctggaccaagtaggagatacaacgaactagtggctgcaccatctcgtctt

SEQ ID NO: 784777 - DNA, 504 bp, Homo sapiens
  misc_feature: HIJSMM301A8YYO.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagatttttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctgccccctcggtca

SEQ ID NO: 784778 - DNA, 506 bp, Homo sapiens
  misc_feature: HIJSMM301EFM54.41.33.C11.1.454.light.4.raw
tctatactatcacgaccggtgctcgatttagagtgagctcgttgggtttggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcaggtgggtctgggacagagttcactctcaccatcagcactctacagtctgaggattatgctagtttactactgtctgcagtaataaagactggccttagggtctaccgtttccggcccgtcgggacctaaaggtgggtaattttacgaaaacgaacgtgtggctgcacc

SEQ ID NO: 784779 - DNA, 492 bp, Homo sapiens
  misc_feature: HIJSMM301BYX0Y.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctggggacagagttcactctcaccatcagcagcctgcagtctgaagattttgcggtttatactgtcagcagtataataactggcctcacggtacacttttggccagggaccaagctggagatcaaacgaactgtggctgcaccatct

SEQ ID NO: 784780 - DNA, 501 bp, Homo sapiens
  misc_feature: HIJSMM301BKWYQ.19.78.H01.1.454.light.4.raw
  modified_base (427)..(427): a, c, t, g, unknown or other
  modified_base (495)..(495): a, c, t, g, unknown or other
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgnagggtctatctcttatgtcttcggaatgggaaccagggtcaccgtcaggtcagcccaaggccaacccntgtcta

SEQ ID NO: 784781 - DNA, 493 bp, Homo sapiens
  misc_feature: HIJSMM301ERGLC.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctagaaaatcagtagggtggaggctgaggatggttggggtttattactgcatgctaagttactacaaacttcctactacttttggccaggggaccaagctggagatacaaacgaa

SEQ ID NO: 784782 - DNA, 513 bp, Homo sapiens
  misc_feature: HIJSMM301EKYKC.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctcctgggctccaggctgaggatgaggctgattaattactgcagctcatatgcaggcagcagcaagtccccatgtgatcgttcgggcggggggaccaagctgccgtcctaggtcagcccaaggctcgtccccccg

SEQ ID NO: 784783 - DNA, 481 bp, Homo sapiens
  misc_feature: HIJSMM301AELUJ.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagtattttactttcaccatcagcagcctgcagcctgaagatattgcaacatattactgtcagcagtatgataatctcccgatcaccttcggccgaaggacacgacgtaggagtaataaacgactagtggctcgcacct

SEQ ID NO: 784784 - DNA, 485 bp, Homo sapiens
  misc_feature: HIJSMM301A0TB7.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctatctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 784785 - DNA, 502 bp, Homo sapiens
  misc_feature: HIJSMM301DJKQZ.16.86.H09.1.454.light.4.raw
  modified_base (481)..(481): a, c, t, g, unknown or other
tgtactactccacgaccggtgctcgatttagtgctatagacttgggtttgggggggggtctcaggaggcagcgctctcaggacatctccaccatggcctgggctctgctgctcctcaccctcctcactcagggcacaggtgacgcctccagggaaggggcttcagggacctctgggctgatccttggtctccttctcctcaggctcaccggggcccagcactgactcactggcatgtgtttctccctctttccagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttatgaggtcagtaatcggccctcaggggtttctaatcgcttctctggctccaagtctggcaacncggacctccctgacccatctc

SEQ ID NO: 784786 - DNA, 510 bp, Homo sapiens
  misc_feature: HIJSMM301CWCNS.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtagtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacaccccctcactttcggcggaggggccaaggtggagatcaagcgaactgtggctgcaccatctgtcttcattccttcccgcc

SEQ ID NO: 784787 - DNA, 506 bp, Homo sapiens
  misc_feature: HIJSMM301E3RNZ.51.27.C05.1.454.light.4.raw
cgatcgtatacacgaccggtgctcgatttagacgcgatcgaagggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtcccgatactgctcctctatcatgatgccaagcggccctcagggatccctgagcgattctctggctccaactctggggacacagccactctgaccatcccgcgggaccccagggctgtggatgaggcctgactattactgtcaggcgtgggacagggaggctgcgagttttcggcggagggaccagtctgaccgtcctagggtccagcccaaggctgccccctcggtcacgtcttcg

SEQ ID NO: 784788 - DNA, 498 bp, Homo sapiens
  misc_feature: HIJSMM301CDQDN.10.43.D10.1.454.light.4.raw
  modified_base (381)..(381): a, c, t, g, unknown or other
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggngcctgaagatgttgcagtttattactgtcaacatcgtaccgagtggccgtccgggggccactttcggccctgggaccaagtggatatcaaacgaactgtggctgcacatctgtcttc

SEQ ID NO: 784789 - DNA, 500 bp, Homo sapiens
  misc_feature: HIJSMM301AICWJ.16.78.H01.1.454.light.4.raw
tgtactactccacgaccggtgctcgatttagtgtgagtagtttgggtttgggggagggaactgctcagttaggacccagacggaaccatggaagccccagcgcagcttctcttcctcctgctactctggctcccagataccactggagaaatagtgatgacgcagtctccagccaccctgtctgtgtctccagggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctaggagatcaaacgaactgtggctgcaccatctgtt

SEQ ID NO: 784790 - DNA, 467 bp, Homo sapiens
  misc_feature: HIJSMM301C5P9N.7.81.H04.1.454.light.4.raw
  modified_base (454)..(454): a, c, t, g, unknown or other
  modified_base (458)..(458): a, c, t, g, unknown or other
  modified_base (466)..(466): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggcctggactgagtgcatangaanagaactgng

SEQ ID NO: 784791 - DNA, 493 bp, Homo sapiens
  misc_feature: HIJSMM301D0VV5.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggcgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttagtgtcttcggaactgggacccctacgttaccgtcctaggtccagtaccccg

SEQ ID NO: 784792 - DNA, 513 bp, Homo sapiens
  misc_feature: HIJSMM301AE2LM.48.26.C04.1.454.light.4.raw
agtatacatacacgaccggtgctcgatttagtctagcgacttttgggttttgggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcgaggggtccctgatcgcttctctggctccaagtctggcaacacggcctccctgaccgtctctgggctccaggctgaggatgaggctgattattactgcagctcatatgcaggcagcaacaatgtggtagttcgggcggaagggaccaagctacgaccgtcctaggtcagcccaaggctcgccccctcc

SEQ ID NO: 784793 - DNA, 498 bp, Homo sapiens
  misc_feature: HIJSMM301ETJ64.12.67.G01.1.454.light.4.raw
atacgacgtacacgaccggtgctcgatttagagtatacatattgggtttggggtgggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtggaccaggtcaccgtcctacgtcagcccaggccaaccc

SEQ ID NO: 784794 - DNA, 498 bp, Homo sapiens
  misc_feature: HIJSMM301A23QX.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggaagtgggtctgggacagagttcactctcaccatcagcagcctgcagtctgaagattttgcagtttattactgtcagcagtataattactggcctcggacgttcggccaagggaccaaggtggaagtcgaaacgaacgtagtggcgtgcaccatctgtcttcta

SEQ ID NO: 784795 - DNA, 497 bp, Homo sapiens; identical to SEQ ID NO: 707352
  misc_feature: HIJSMM301EYZWK.18.59.F04.1.454.light.4.raw

SEQ ID NO: 784796 - DNA, 505 bp, Homo sapiens
  misc_feature: HIJSMM301D2A7H.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatactttgtcttggaactgggacaggtcaccgtcctaggtcagcccaagccaacccactgtcactctcg

SEQ ID NO: 784797 - DNA, 481 bp, Homo sapiens
  misc_feature: HIJSMM301DIYQ7.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttggctctattattgcatgcagctctacaagtcccgctcactttcggcggagggaccaaggtggagatcaaacga

SEQ ID NO: 784798 - DNA, 514 bp, Homo sapiens
  misc_feature: HIJSMM301AJYTD.52.57.F02.1.454.light.4.raw
  modified_base (432)..(432): a, c, t, g, unknown or other
cgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaacgcccccaaactcatctatttttgaggtcactaagcggccctcagggtccctgatcgcttctctggctcgaagtctggcaacacggcctccctgaccgtctctgggctccaggctgaggatggaggctgattactactgcacctcatatgcnggcgacaactaatttgggggtttcggcgggagggacaggtgacccgttcctacgtcacgcccaaggctcgccccctcggtcc

SEQ ID NO: 784799 - DNA, 523 bp, Homo sapiens
  misc_feature: HIJSMM301AO8JX.27.23.C01.1.454.light.4.raw
  modified_base (227)..(227): a, c, t, g, unknown or other
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttctatatacaaccagtgaacacttgggtgtttcggcggtagggaccaggctgaccgtctaggtcagccaaggctgcccctcggtcacgtctgttccaccct

SEQ ID NO: 784800 - DNA, 494 bp, Homo sapiens
  misc_feature: HIJSMM301A2DOA.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaatctggccagcctcccaggctcctcatctatggtgaatccaacagggccactggcatcccagacaggttcagtggcagtgggtctgggacagacttcactctcaccatcagcagactggagcctgaggattttgcagttgtattactgtcagcagtatcataggtcaacaccttcggccagggacacgactggagattaaagaacgtagtggctgcaccatctgtcttctatcttccccg

SEQ ID NO: 784801 - DNA, 502 bp, Homo sapiens
  misc_feature: HIJSMM301A4PLI.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggacgtcgtcacggacgaagaggagacaacgaacagtggctgcacactctgtcttctatcttcccgccctacta

SEQ ID NO: 784802 - DNA, 511 bp, Homo sapiens
  misc_feature: HIJSMM301B8VMD.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtggggtttactatgcatgcagggtacactcgtggccggttcactttttgggccacgggggaccaaaccgtggattatcctagaacggaacctgtcggcttggcctaaccc

SEQ ID NO: 784803 - DNA, 518 bp, Homo sapiens
  misc_feature: HIJSMM301ESR2O.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgatttattatttgcagctcattatgcagggcaggtttaacaattgtgatattcggcgggagggaacccaaacgtcgaccgtcctaggtcagcccaaggctcgcccccttc

SEQ ID NO: 784804 - DNA, 511 bp, Homo sapiens
  misc_feature: HIJSMM301ADIA8.40.54.E10.1.454.light.4.raw
  modified_base (458)..(458): a, c, t, g, unknown or other
tctagcgactcacgaccggtgctcgatttagatcgtagcagaacacacaaagggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcacgggacccctgagcgattctctggctccaggtcagggacaacagtcacgttgaccatcagtggagtccgaggcagaagacgaggctgactattactgtcaatcagcagacagcaggtggttacgttttcggggtttcggtcgggngggaccgaagctggaccgtccgtacggtacagcccaagcctcgccccctcggt

SEQ ID NO: 784805 - DNA, 527 bp, Homo sapiens
  misc_feature: HIJSMM301AZG6L.41.19.B08.1.454.light.4.raw
  modified_base (463)..(463): a, c, t, g, unknown or other
tctatactatcacgaccggtgctcgatttagtgagtcagtaaggggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgctttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgaggggtgattatttctgcagctcatttacaaccagccacaccttgctcttcggaactgggaccncggtcatcgtcctaggtcacgcccaaggccaacccccactgtcactctcgttcccaccctccta

SEQ ID NO: 784806 - DNA, 487 bp, Homo sapiens
  misc_feature: HIJSMM301A02NL.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagccccctaaatcctgatctatgctgcatccagtttgcaaagtgaggtcccatccaggttcagtggcagtggatctgggacagatttcactctcaccatcagtagtctgcaacctgtaagattttgcaacttactactgtcaacagagttacggtacctgctcactttcggacggagggaccgaaggtggagatacaaacgaactgtggctgcaccta

SEQ ID NO: 784807 - DNA, 495 bp, Homo sapiens; identical to SEQ ID NO: 575693
  misc_feature: HIJSMM301AEE4I.9.1.A01.1.454.light.4.raw

SEQ ID NO: 784808 - DNA, 382 bp, Homo sapiens
  misc_feature: HIJSMM301A1R5X.48.34.D01.1.454.light.4.raw
agtatacatacacgaccggtgctcgatttagatcgtctgtgttgggtttgggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctctttactgggcgtcttcccgggagtccggggtccctgaccgattcagtgccagcgggtctgggacagacttcactctcacca

SEQ ID NO: 784809 - DNA, 485 bp, Homo sapiens
  misc_feature: HIJSMM301A7MGY.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagtattttgactaatttattactgtcagcagtataataactggtggacgttcggaccaagggaccgaaaggtagaaatacgaaacgaacgtgtaggc

SEQ ID NO: 784810 - DNA, 518 bp, Homo sapiens
  misc_feature: HIJSMM301A7Z98.48.71.G05.1.454.light.4.raw
agtatacatacacgaccggtgctcgatttagtgtcgtcgcaagagagaggggggctgtgggtccaggaggcagaactctgggtgtctcaccatggcctgggtccccctacttctccccctcctcactctctgcacaggctctcaggcctcctatgagttgacacagccaccctcggtgtcagtgtccccaggacagacggccaggatcacctgctctggagatggattgccaacacaatatgcgtactggtaccagaagaagccaggccaggcccctgttttggtgatatatcaagacactcagagggcctcagggacccctgagcggttctctggctccagctcgaggggcaacagtcgcgttgacaatcagggaagtccaggcagaggacgaggctgactattactgtcagtctgcagacaacggaggtacttacttggttcttcggcgggagggaccgaagttgaacgtccgtgggtcagcccaaggctcgcccctcggtccactctcgtcccgt

SEQ ID NO: 784811 - DNA, 523 bp, Homo sapiens
  misc_feature: HIJSMM301EJV5R.11.57.F02.1.454.light.4.raw
  modified_base (508)..(508): a, c, t, g, unknown or other
cgagagataccacgaccggtgctcgatttagctcgatatagttgggtttgggggaggaactgctcagttaggacccagagggaaccatggaagccccagctcagctttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccaactggcatcccacccaggttcagtggcagtgggtctggggacagacttcattctcaccatccgcagcctagagcctgaagattttgcagtttattactgtcaacagcgtagcagcaggcctcggcgacgttcggccaagggaccaaggtggaacgtacgaacgcgaacgtagtggctgcaccatctgttcttcanctttccgcccattcg

SEQ ID NO: 784812 - DNA, 487 bp, Homo sapiens
  misc_feature: HIJSMM301EUJWT.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggagctgaggatgttgggctctattattgcatgcaagctctacaagtcccgctctactttcggcggagggaccgaaggtggagatacaaacgtaa

SEQ ID NO: 784813 - DNA, 512 bp, Homo sapiens
  misc_feature: HIJSMM301EVT01.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtggtctgggacagacttcactctcaccatcagcagcctagagcctgaagactttggactttattactgtcagcagcgtgagttctggcctccgctcactttcggacggagggaccgagggtggagatacctaaaacgaacctggtggtcctggccaccattcctagtctttcacttccc

SEQ ID NO: 784814 - DNA, 504 bp, Homo sapiens
  misc_feature: HIJSMM301DEA7F.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgccttggcttttcggcggagggccaagctgaccgtcctggtcagcccaaggctgccccctcggtcta

SEQ ID NO: 784815 - DNA, 509 bp, Homo sapiens
  misc_feature: HIJSMM301C13UE.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagccccaaactcatcatttatgatgccactaagcggccctcaggggtttctaatcgcttctctggctccaagtctggcaacacggcctccctgacaatctctgggctccaggctgagggacgaggctgattactactgctgctcatatgcaggtcgtatctcttatgttcttcggaacgtcgggaccaaaggtcaccgtcctaggtcagcccaggccaacccactgtcta

SEQ ID NO: 784816 - DNA, 500 bp, Homo sapiens
  misc_feature: HIJSMM301CLT1D.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaatctggccagcctcccaggctcctcatctatggtgaatccaacagggccactggcatcccagacaggttcagtggcagtgggtctgggacagacttcacttctcaccatcagcagactggagcctgaggattttgcagtgtattactgtcagcagtatcataggtcaaacaccttcggccaagggacaccggactggagattaaaggaactgtcggctggcaccatctgtcttcagttcttccccg

SEQ ID NO: 784817 - DNA, 511 bp, Homo sapiens
  misc_feature: HIJSMM301ARJGP.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtcgtggcaacacggcctccctgaccatctctgggctccaggctgaggacgaggctgattattactgcagctacatatacaagccaccagcactctctatcgttcttacggaacgtcgggaccaaggtccaccggtcctaggtcacgcccaacgga

SEQ ID NO: 784818 - DNA, 493 bp, Homo sapiens
  misc_feature: HIJSMM301EIRLK.16.72.G06.1.454.light.4.raw
  modified_base (413)..(413): a, c, t, g, unknown or other
tgtactactccacgaccggtgctcgatttagctacgactgcaagggaaaggggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcngcagtataataactggcctccggtcactttcggcggagggaccaaggtggaggatcaaacgaatacgtggctggcaccat

SEQ ID NO: 784819 - DNA, 521 bp, Homo sapiens
  misc_feature: HIJSMM301A0Q9S.5.59.F04.1.454.light.4.raw
atcagacacgcacgaccggtgctcgatttagtacacacacttagggattggggctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagtattttgcagtgtattactgtcagcagtatggtagctcacggacgttcggccgaacgggaaccgaaggtaggaaactacaaacgaactgtaggcgtcgcacctactctgttcttctactccttcccgacccgta

SEQ ID NO: 784820 - DNA, 491 bp, Homo sapiens
  misc_feature: HIJSMM301AF8G2.14.36.D03.1.454.light.4.raw
cgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatggttggttttcgggcggggggtaccgaaggtgaccgtcctaggt

SEQ ID NO: 784821 - DNA, 491 bp, Homo sapiens
  misc_feature: HIJSMM301DS277.26.37.D04.1.454.light.4.raw
  modified_base (488)..(488): a, c, t, g, unknown or other
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattacttgtcagcaatataatacctggccttccgctcacctttcggcggagggaccaaggttgagatcaaacgaactgtggctgcncta

SEQ ID NO: 784822 - DNA, 529 bp, Homo sapiens
  misc_feature: HIJSMM301CKKID.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcaggtgggtctgggacttcgttcactctcaccatcaataacctgcaatctgacgactttgctagtttatttctgtcagcagtctgaagactggccgttctacgtttcggcggtacgggacccaaggtcgggaccttaccgaaacgaaccgtgtggctgcaccatcttgtcttcactccttcccgccattccg

SEQ ID NO: 784823 - DNA, 511 bp, Homo sapiens
  misc_feature: HIJSMM301BZDHB.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataactttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcacgcccaaggctcgccccctcggtcactctgtt

SEQ ID NO: 784824 - DNA, 494 bp, Homo sapiens
  misc_feature: HIJSMM301EL0GT.43.73.G07.1.454.light.4.raw
tgtgagtagtcacgaccggtgctcgatttagctctacgctcaggggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccaagggggatgggcatccctgatcggttctcagtcttgggctcaggcctgactcggtccctgaccatcaacaacatccaggaagaggatgacagtgactactactgtgggacgaattatggcagtgggaataccgtacatgtatgtcttggagtgggacgaaggtcacgtcaaggtcacg

SEQ ID NO: 784825 - DNA, 489 bp, Homo sapiens
  misc_feature: HIJSMM301DIBFW.46.26.C04.1.454.light.4.raw
  modified_base (433)..(433): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagtcagagcctcctgcatagtaatggagacaactatttggattggtacctgcagaagccagggcagtctccacagctcatcatctatttggttctaatcgggcctccggggtccctgaccaggttcagtggcagtggatcaggcacagattttacactgaaaatcagcagagtggaggctgaggatgttgggctctattattgcatgcaagtntctacagtcccgctcactttccggaggacgggaaccaggtggagactacaaacgaa

SEQ ID NO: 784826 - DNA, 483 bp, Homo sapiens
  misc_feature: HIJSMM301C935D.41.15.B04.1.454.light.4.raw
tctatactatcacgaccggtgctcgatttagacagtatatatccgcgggcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccaatcattgggtgttcggcggagggaccaaactgaccgtcctaggtcagcccaaggcctgccccctcggtccactctcgttcccgccctcctcactagtataga

SEQ ID NO: 784827 - DNA, 490 bp, Homo sapiens
  misc_feature: HIJSMM301BOMOH.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggcctcaggggtttctaatcgcttctctggctccaagtctggcaacacggcctccctgaccatctctgggctccaggctgaggacgaggctgattattactgcagctcatatacagcagcagcactctcgtggtattcggcggagggaccaagctgaccgtcctaggtcagcccaa

SEQ ID NO: 784828 - DNA, 461 bp, Homo sapiens
  misc_feature: HIJSMM301AL2WT.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgagggctgattattactgtgcagcatgggattacaacctgagtgatcctagttgggtgttcggcggagggaccaggctgaccgtcctaggtcagccaaggctgccccctcggtcactctcgttcccaccctcctcacgcgtatgt

SEQ ID NO: 784829 - DNA, 511 bp, Homo sapiens
  misc_feature: HIJSMM301C2VRM.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattattgctgctcatatgcaggtagttacactttatgtcttcggaatttgggacgtacggtcaccgtcctaggtcacgcccaaggcccaacccactgt

SEQ ID NO: 784830 - DNA, 533 bp, Homo sapiens
  misc_feature: HIJSMM301A1RGX.8.28.C06.1.454.light.4.raw
ctcgcgtgtccacgaccggtgctcgatttagagctcacgtattgggtttgggggggaactgctcagttaggacccagacggaaccatggaagcccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttcttgtcagcagtctgaagactggccgttcactttcggtcggagggaccgaaggtggaccgtcaaaccaaactacgtggcgtgcaccactcttgtcgtttctactccttccccgtcccgactcttacg

SEQ ID NO: 784831 - DNA, 541 bp, Homo sapiens
  misc_feature: HIJSMM301AT0SL.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattatttattgtagttcatatacaaccagtgacacttgggtggtttcggcgggacgggaccgaggctggaccgtcctaggtcacgcccgaaggctcgtccccctccggtcctacctcctcgttcccgtcccgt

SEQ ID NO: 784832 - DNA, 515 bp, Homo sapiens
  misc_feature: HIJSMM301BHP4P.9.81.H04.1.454.light.4.raw
tgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgacctctctgggctccgaggctgacgatgaggctgattattactgcagctcatatgcaggcacccacaatgttcttggagtgggacccacggtccaccgtcctaggtcacgcccaacggaccaacccccactacgtcgtacttccg

SEQ ID NO: 784833 - DNA, 478 bp, Homo sapiens; identical to SEQ ID NO: 597581
  misc_feature: HIJSMM301EFA93.40.59.F04.1.454.light.4.raw

SEQ ID NO: 784834 - DNA, 525 bp, Homo sapiens
  misc_feature: HIJSMM301DO73Y.21.87.H10.1.454.light.4.raw
tcgtcgctcgcacgaccggtgctcgatttagcagtactgcgttggggtttgggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaaggctaatttattactgctcctacatacgtcaaggtggcacatttttcgttggtttttggtcgggtcgggaccccgaagaatgactgtcctcaagtcagcccgaaggcctgccccctcggt

SEQ ID NO: 784835 - DNA, 505 bp, Homo sapiens
  misc_feature: HIJSMM301AZ8BX.43.34.D01.1.454.light.4.raw
tgtgagtagtcacgaccggtgctcgatttagatcgtctgtgttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgtacggtcaccgtcctaggtcacgcccaaggcctaaccccca

SEQ ID NO: 784836 - DNA, 485 bp, Homo sapiens; identical to SEQ ID NO: 602674
  misc_feature: HIJSMM301B2BCL.26.78.H01.1.454.light.4.raw

SEQ ID NO: 784837 - DNA, 501 bp, Homo sapiens
  misc_feature: HIJSMM301B70A8.43.34.D01.1.454.light.4.raw
  modified_base (490)..(490): a, c, t, g, unknown or other
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattactgcaactcacttacaacgaccgacacttgcgtattcggcggcggaccaagctgacgtcctaggtcagccaaggcncgcccctcggt

SEQ ID NO: 784838 - DNA, 503 bp, Homo sapiens
  misc_feature: HIJSMM301BBLZM.19.67.G01.1.454.light.4.raw
tactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaatttttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttggcggagggaccgaagctgaccgtcctaggtcagcccaaggctgccccctc

SEQ ID NO: 784839 - DNA, 497 bp, Homo sapiens
  misc_feature: HIJSMM301A1B2O.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaacggcccaaccccactgtcactctccg

SEQ ID NO: 784840 - DNA, 493 bp, Homo sapiens
  misc_feature: HIJSMM301A88XA.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagccggccctcaggtattcctgagcgattctctggctccagttctgggaacacagccactctgaccatcagcgggacccaggctatggatgaggctgactattactgtcgaggcgtgggacatcagcgagtgtagggttgggttttcgggcgggagggaccgaagcgtcgaccgtcctaagtccagaccccg

SEQ ID NO: 784841 - DNA, 425 bp, Homo sapiens
  misc_feature: HIJSMM301EEHJH.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggcccaaccccactgtcactctcgttccccgccctcctcagacgtatca

SEQ ID NO: 784842 - DNA, 493 bp, Homo sapiens
  misc_feature: HIJSMM301ANZL0.8.53.E09.1.454.light.4.raw
ctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtacgccaggttccaggcacagcccccagactcctcattaatgataacaacaatcggccctcagggggtctctgaccgattctctgcctccaagtctggcacttctgcctccctggtcatatctggtctccagggtgaggatgaggctgattattactgccactcctaatgacaacacgcctgaggtatttggcttgttcggcgggcgggaccgaagttac

SEQ ID NO: 784843 - DNA, 454 bp, Homo sapiens; identical to SEQ ID NO: 535005
  misc_feature: HIJSMM301DGAVP.19.86.H09.1.454.light.4.raw

SEQ ID NO: 784844 - DNA, 497 bp, Homo sapiens
  misc_feature: HIJSMM301BPV0G.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgctagtttattacttgtcagcagcgtagcaactggcctctcactttcggcggagggaccaaggtggagatcaaacgaactgtggctgcaccatctgtctt

SEQ ID NO: 784845 - DNA, 491 bp, Homo sapiens
  misc_feature: HIJSMM301BLFC8.43.53.E09.1.454.light.4.raw
tgtgagtagtcacgaccggtgctcgatttagagagagtgtgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctcctcccccctacaactttcggtcaggggaccaagttgaacatcaatcgaactgtggctgcaccat

SEQ ID NO: 784846 - DNA, 501 bp, Homo sapiens
  misc_feature: HIJSMM301D6FHK.22.27.C05.1.454.light.4.raw
acatacgcgtcacgaccggtgctcgatttagacgcgatcgaagggtttggggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggctagtttattactgtcagcaatattatattcctcctcagacgttcggccaagggaccaggtggaaatcaaacgactagtggctgcaccta

SEQ ID NO: 784847 - DNA, 481 bp, Homo sapiens
  misc_feature: HIJSMM301C5C42.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtgagatcaaacg

SEQ ID NO: 784848 - DNA, 524 bp, Homo sapiens
  misc_feature: HIJSMM301DRQOR.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagccctgatgacttttagtcgacttattattgtaccaacaagtataaagtagttaatttcaaactttcggtcccgttccggaccgtaacgaacgtggtagtaagttctaaacgaaactaacgtaggtcgtgtcacaactactcgttccg

SEQ ID NO: 784849 - DNA, 505 bp, Homo sapiens
  misc_feature: HIJSMM301DH81Z.52.29.C07.1.454.light.4.raw
cgcagtacgacacgaccggtgctcgatttagagtgctacgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgacccatcagtggagtccgaggcagaagacgaggctgactatttctgtcaatcttcagacatcagtggtacttatgtctttcggaactaggaccgaaggtcaccgtcctaggtcagcccaacggcccaaccccactcgtcactctt

SEQ ID NO: 784850 - DNA, 504 bp, Homo sapiens
  misc_feature: HIJSMM301BEGD6.48.36.D03.1.454.light.4.raw
agtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctcctgaccatctctgggctccaggctgaagatcaggctgattattactgctgttctattttctaagtttcctttttgtcttcggaactcgggacgaggtcaccgtcctaggtcacgccaacggccaacccactcgt

SEQ ID NO: 784851 - DNA, 507 bp, Homo sapiens
  misc_feature: HIJSMM301AOM6A.48.71.G05.1.454.light.4.raw
agtatacatacacgaccggtgctcgattagtgtcgtcgcaagagagaggggggagagaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagttgtttttctgtcagcagtatggaagttcacctcggacattcggccgaggggaccaaggtggaaatcaaacgaactgtggctgcaccatctgtcttcattcc

SEQ ID NO: 784852 - DNA, 507 bp, Homo sapiens
  misc_feature: HIJSMM301EA9AM.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctggctccaggctgatgacgaggctgattattactgcaggtcatatacaatcagacaacacttatgtcttcgggactgggaccaagatccaccgtcctaggtcagcccaaggacccaaccccactgtcta

SEQ ID NO: 784853 - DNA, 512 bp, Homo sapiens
  misc_feature: HIJSMM301ECQKV.5.58.F03.1.454.light.4.raw
  modified_base (430)..(430): a, c, t, g, unknown or other
atcagacacgcacgaccggtgctcgatttagtctgatcgagaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggttatcagggcaataagcggccctcaggggtttctaatcgcttctctggctccaagtctggcaacacggccgccctgacaatctctgggctccaggctgacgacgaggctgatttttactgctgctcatatgcaggtnatcacacttttatgtttcgggaactgggaccaaggtcaccgtcctaggtcagcccaaggccaacccccactgtcactcttcg

SEQ ID NO: 784854 - DNA, 521 bp, Homo sapiens
  misc_feature: HIJSMM301ECXH2.41.30.C08.1.454.light.4.raw
tctatactatcacgaccggtgctcgatttagtctgacgtcaaagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaagtcatcatttatgatgtcggtagtcggccctccggggtctctagtcgtcttctctggctccaagtctggcaacacggcctccctgaccatctctgggctccaggctgaggacgaggctgactattactgcagttcatatacaagcagcagcactggagtcttcggaacgtgggaccagggtcaccgtcctaaggtccagcccaacggcccaaccccactgtcactcttccg

SEQ ID NO: 784855 - DNA, 507 bp, Homo sapiens
  misc_feature: HIJSMM301A1OAQ.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaactttttagatgaggccgactatttctgtcacacgtgggacgatgggcacctgcgatcttcggtcggagggaccgaagacttgaccgtcctcgggtcgagcccaacggctcgccccctccggtcactt

SEQ ID NO: 784856 - DNA, 488 bp, Homo sapiens
  misc_feature: HIJSMM301DLOHQ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtataggtcacgtcccaagtaacttttggccaggggaccaagctggagatcaaacgaactgtggctgcaccat

SEQ ID NO: 784857 - DNA, 499 bp, Homo sapiens
  misc_feature: HIJSMM301ES9P4.19.67.G01.1.454.light.4.raw
  modified_base (445)..(445): a, c, t, g, unknown or other
tactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccacattgtgatctatgaggataatcaaagaccgtctggggtccctgatcggttctctggctccatcgacagctcctccaaactctgcctccctcaccatctctggactgaagactgaggacgaggctgactacactgtcagtcttatgatagccgcggtcaatgnggtcttggcggagggccaagctgacgtcctaggtcagcccaaggctgccccctc

SEQ ID NO: 784858 - DNA, 524 bp, Homo sapiens
  misc_feature: HIJSMM301B85FQ.12.71.G05.1.454.light.4.raw
  modified_base (439)..(439): a, c, t, g, unknown or other
  modified_base (511)..(511): a, c, t, g, unknown or other
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagnacttgggtgttcgggcggcgggaccaaagtgacgtcctaagtcaggcccaaggctgccccctcggtcactcncgttcccaccctt

SEQ ID NO: 784859 - DNA, 490 bp, Homo sapiens
  misc_feature: HIJSMM301DJECA.47.62.F07.1.454.light.4.raw
  modified_base (407)..(407): a, c, t, g, unknown or other
  modified_base (459)..(459): a, c, t, g, unknown or other
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgacaacatattacngtcaacagtatcataatctccccactttcggccctggaccaaagtggatatnaaaaccgaactagttggctgcaccatctgtt

SEQ ID NO: 784860 - DNA, 499 bp, Homo sapiens
  misc_feature: HIJSMM301BET5U.46.35.D02.1.454.light.4.raw
  modified_base (485)..(485): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattacttgtcagcagtatggtcacgtcccaagtaacttttggccgaggggaccaaggctggagatacaaacgaactgtggtcngtcacccatcttcg

SEQ ID NO: 784861 - DNA, 463 bp, Homo sapiens
  misc_feature: HIJSMM301EA4CD.22.28.C06.1.454.light.4.raw
acatacgcgtcacgaccggtgctcgatttagagctcacgtattggggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggacgggaccaggctgaccgtcctaggtcagcccaaggctcgcccctcggtcactctcgttcccaccctcctcacgcgtatgt

SEQ ID NO: 784862 - DNA, 491 bp, Homo sapiens
  misc_feature: HIJSMM301ALV85.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtagttcggcggtgggaccaagctgaccgtcctaggtcagccc

SEQ ID NO: 784863 - DNA, 503 bp, Homo sapiens
  misc_feature: HIJSMM301BZZ1Z.4.27.C05.1.454.light.4.raw
agcactgtagcacgaccggtgctcgatttagacgcgatcgaagggtttggggtgactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcaggtggcagtggatcaggcacagattttaacactgagaatcagcagagtggaggctggaggatggttggggtttactactgcatgcaagctactacaagccacctacctacttttggtccgacggggaccaggctggagataccgaaaacgaaac

SEQ ID NO: 784864 - DNA, 511 bp, Homo sapiens; identical to SEQ ID NO: 754891
  misc_feature: HIJSMM301A2OPO.16.1.A01.1.454.light.4.raw

SEQ ID NO: 784865 - DNA, 507 bp, Homo sapiens
  misc_feature: HIJSMM301A0GHZ.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgacttccgccaacgcagggatattactcatctctgggctccagtctgacgatgagctgactattactgtttgacttggcacaacaacgcctggatcttcggacctgggaccacggtcaccgtctaggtcacgcccaaggccaaccccactgtcactctgttcccccg

SEQ ID NO: 784866 - DNA, 523 bp, Homo sapiens
  misc_feature: HIJSMM301BQUEV.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcacgcacgtccccctatgtgattccgttcgggccggggggaccaacggctcgtacccggtcctaggtacacgacccaacggcccg

SEQ ID NO: 784867 - DNA, 528 bp, Homo sapiens
  misc_feature: HIJSMM301CWTWZ.17.75.G09.1.454.light.4.raw
cgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcgggggcaaagctgccctgaccctaacgggggcgcagcctgaggacgaggccgactattattgcctactatcatttgatggtggtcgtctgcccattttcggcggcgggaccagggtggccgtcctgggtcagcccaaggctcgccccctcggtcactctgttcccacctccctcctacgtctacg

SEQ ID NO: 784868 - DNA, 506 bp, Homo sapiens
  misc_feature: HIJSMM301B8ICQ.13.38.D05.1.454.light.4.raw
tcacgtactacacgaccggtgctcgatttagtatctgatagttgggtttggggtgggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgagggcccaggcagaagatgaatctgattattactgtgttctttatatggtagtgcatttctgctgtgttcggtaggaggcgacccggctgacccgtcctcggtcacggcccaaggctccg

SEQ ID NO: 784869 - DNA, 524 bp, Homo sapiens
  misc_feature: HIJSMM301DQKUG.41.53.E09.1.454.light.4.raw
tctatactatcacgaccggtgctcgatttagagagagtgtgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccatctctgggctccaggctgaggacgaggctgattattactgcagctcatatacaagcagcagcactctcgtggtattcgggcggagggaccaagctgaccgtcctaggtcaacgcccaaggcctcgccccctcggtccactccttccg

SEQ ID NO: 784870 - DNA, 486 bp, Homo sapiens
  misc_feature: HIJSMM301D9KL1.52.69.G03.1.454.light.4.raw
cgcagtacgacacgaccggtgctcgatttagtcgctgcgtaaaggagaaaggggagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaagaaccggggagagcccctaaactcctgatccatactgcatccactttgcatgctggggtcccattcaggttcggcggcagtggatctgggacagaattcactctcacaatcagcagcctgcagactgaagactccgcaatttattactgtcaacaacgtcaccgttacccgatccaccttcggccaagggacacggctggagattaaacgaactgtggctgcaccatctgtt

SEQ ID NO: 784871 - DNA, 444 bp, Homo sapiens; identical to SEQ ID NO: 535042
  misc_feature: HIJSMM301DPYIC.10.76.G10.1.454.light.4.raw

SEQ ID NO: 784872 - DNA, 530 bp, Homo sapiens
  misc_feature: HIJSMM301EUL6T.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtcgacacttgggtgttcggcggagggaccaggctgaccgtcctaggtcagcccaaggctcgccccctcggtcacctctcgttccccgccctccc

SEQ ID NO: 784873 - DNA, 500 bp, Homo sapiens
  misc_feature: HIJSMM301CPCPJ.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtactcccagccaggttcagtggcagtgggtctgggacagagttcactctcaccatcagcagcctgcagtctagaagattttgcggttttattactgtcagcagtataataactgcctccacggtacacttttggcctaggggaccaagctggagatcaaacgaactgtggctgcaccatctgtt

SEQ ID NO: 784874 - DNA, 480 bp, Homo sapiens
  misc_feature: HIJSMM301E0IQT.52.69.G03.1.454.light.4.raw
  modified_base (443)..(443): a, c, t, g, unknown or other
cgcagtacgacacgaccggtgctcgatttagtcgctgcgtaaaggagaaaggggagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaagaaccggggagagcccctaaactcctgatccatactgcatccactttgcatgctggggtcccattcaggttcggcggcagtggatctgggacagaattcactctcacaatcagcagcctgcagactgaagatccgcaatttattactgtcaacaacgtcaccgtacccgatcaccttcggccaaggganacggctggagattaaacgaactgtggctgcaccatct

SEQ ID NO: 784875 - DNA, 502 bp, Homo sapiens; identical to SEQ ID NO: 682234
  misc_feature: HIJSMM301BXVEY.21.81.H04.1.454.light.4.raw

SEQ ID NO: 784876 - DNA, 498 bp, Homo sapiens
  misc_feature: HIJSMM301BN2IF.11.81.H04.1.454.light.4.raw
  modified_base (196)..(196): a, c, t, g, unknown or other
  modified_base (475)..(475): a, c, t, g, unknown or other
  modified_base (492)..(492): a, c, t, g, unknown or other
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagttttttactgtcagcagtatagtaactggctcgtacactttggcagggacagactagaaatacaaacgaactgtcggntcgcaccaactctcgtnttccta

SEQ ID NO: 784877 - DNA, 499 bp, Homo sapiens
  misc_feature: HIJSMM301EMLY9.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagctgcagtctgaagtattttgtcggtttattactgtcagcagtataataactggcctccacggtacacttttggccaggggaccaagctggagatacaaacgaactgtggctgcaccatctgtt

SEQ ID NO: 784878 - DNA, 516 bp, Homo sapiens
  misc_feature: HIJSMM301DT9OF.17.37.D04.1.454.light.4.raw
cgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggtagggaccaagctgacccgtccttggtcagcccaaggctcgccccctcggtcactctgttcccgt

SEQ ID NO: 784879 - DNA, 514 bp, Homo sapiens
  misc_feature: HIJSMM301AYPFH.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttccccaccctcctcgctacgtag

SEQ ID NO: 784880 - DNA, 502 bp, Homo sapiens
  misc_feature: HIJSMM301DSLSM.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactccttccgaggctcactttcggcgggacgggaccgaaggtggagatacaaaccgtaacta

SEQ ID NO: 784881 - DNA, 518 bp, Homo sapiens
  misc_feature: HIJSMM301ATT39.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggaggactagaactttgctattcggcggagggaaccaaggttcgaccgtcctaagtcagcccaaggctcgccccctacggtcactctcgtt

SEQ ID NO: 784882 - DNA, 498 bp, Homo sapiens
  misc_feature: HIJSMM301EJCFK.9.71.G05.1.454.light.4.raw
  modified_base (457)..(457): a, c, t, g, unknown or other
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatattgggcattataaccttgtctcctggtatcaacaacgcccagacaaagcccccacactcttaatttatgaggtcactaagcggccctcacggggtttctggtcgcttctctgcctcaagtctggcaacacggcctcctgacatctctgggctcagtctgacgacgaggctgattatactgcagctcatatgcagttggttcctctttcaagatattcggcggngggaccaggctgatcgtcctgagtcagacccaaggcctccg

SEQ ID NO: 784883 - DNA, 496 bp, Homo sapiens
  misc_feature: HIJSMM301D9I9P.17.21.B10.1.454.light.4.raw
  modified_base (478)..(478): a, c, t, g, unknown or other
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactagaaaatcagacgagggtggaggctgaggatggtcgggtttactactgcatgcagggtacactctggccgttctacttttggccgaggggaccaaacgtggatatnagacgaactgtggctagc

SEQ ID NO: 784884 - DNA, 511 bp, Homo sapiens
  misc_feature: HIJSMM301A1486.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggcccactggcatcccacccaggttcagtggcagtgggtctgggacagacttcattctcaccatccgcagcctagagcctgaagattttgctagttttattacttgtcaacagcgtagcagcaggcctccggcgacgtcggcgaaggaccaaggtggagtcaagcgaactgtggctgcaccatctgtcttcatccttcccgcct

SEQ ID NO: 784885 - DNA, 450 bp, Homo sapiens
  misc_feature: HIJSMM301C457L.18.9.A09.1.454.light.4.raw
tacgagtatgcacgaccggtgctcgatttagcgagacgcgcaggggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccgccctcctccatactcgta

SEQ ID NO: 784886 - DNA, 543 bp, Homo sapiens
  misc_feature: HIJSMM301AGQMH.17.33.C11.1.454.light.4.raw
cgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgacttattactgcctactctactttggtggtgctgtgctagttcggcggagggaccaagctgaccgtcttaagtctaggccccaaggtcctcggtcccccctcgggtcctattccgttcgttcccccaccccttcccttccccg

SEQ ID NO: 784887 - DNA, 511 bp, Homo sapiens
  misc_feature: HIJSMM301D66S5.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttccttatcgcttctctggctccgagtctggcaacacggcctccctgaccaatctctgggctccaggctgaggacgaggcggattattactgttgctcatatgcgggtagtagcactttcgatgtacctattcggcggagggaccagctgaccgtcctgggtcagcccaaggctcgcccctccgtcaccgtctgttcccaccctcctcctacgtccgtat

SEQ ID NO: 784888 - DNA, 496 bp, Homo sapiens
  misc_feature: HIJSMM301B1Z7R.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacgagcagcctgagtgcttatgtcttcggaactggacacgtcgaccgtcct

SEQ ID NO: 784889 - DNA, 505 bp, Homo sapiens
  misc_feature: HIJSMM301ADZ90.13.11.A11.1.454.light.4.raw
  modified_base (498)..(498): a, c, t, g, unknown or other
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctggaccacggtcaccgtcctaggtcagcccaaggccaaccccactgtcactctnttccccg

SEQ ID NO: 784890 - DNA, 547 bp, Homo sapiens
  misc_feature: HIJSMM301DEKM9.12.71.G05.1.454.light.4.raw
  modified_base (302)..(302): a, c, t, g, unknown or other
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaaacaataccccggcaaagtccccaagttaatcatttangagggcactaagcggccctcaggagtttctgatcgcttctctggctccaaggctggcgaccgggcctccctgacaatatctgggctccaggctgaggacgaggctcattactactgctgctcatatggaggttatagcactttgggtgtttcgggcggcgggaccgaaacggtagaccgtccctaagttaccgagaccccaagactcgcccccctcggtcacctctcgttccctacccccttccc

SEQ ID NO: 784891 - DNA, 503 bp, Homo sapiens
  misc_feature: HIJSMM301BGX3J.3.77.G11.1.454.light.4.raw
  modified_base (491)..(491): a, c, t, g, unknown or other
agacgcactccacgaccggtgctcgatttagctagtcactcaagggaaaggggaggaactgctcagttaggacccagacggaaccatggaagccccagtgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccgggctcctcatctatgatgtgtcttctcgggtcactggtctcccaggcaggttcagtggcagtggatcgtgggacagaattcacgtctcaccatcatcaggctgcggtctgacgacttcgcagtcttattctgtcaacagtacagtcggcccggtcctccggtggactacttcgggcccaaagggtaccaagggtcggacatcagacgaactgnggctgacaccat

SEQ ID NO: 784892 - DNA, 449 bp, Homo sapiens
  misc_feature: HIJSMM301D7TA7.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactcctgttcccaccctcctcccatactcgta

SEQ ID NO: 784893 - DNA, 521 bp, Homo sapiens
  misc_feature: HIJSMM301ER7I2.5.27.C05.1.454.light.4.raw
  modified_base (87)..(87): a, c, t, g, unknown or other
atcagacacgcacgaccggtgctcgatttagacgcgatcgaagggtttggggctgggcctaaggaagcagcactggtggtgcctcanccatggcctggacctttctcctcctcggcctcctctctcactgcacaggctctgtgacctcctatgtgctgactcagccaccctcagtgtcagtggccccaggaaagacggcagggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggcccaaccccactcgtcactctgttcccaccctcctccgtcg

SEQ ID NO: 784894 - DNA, 499 bp, Homo sapiens
  misc_feature: HIJSMM301BYPM3.16.86.H09.1.454.light.4.raw
tgtactactccacgaccggtgctcgatttagtgctatagacttgggtttggggggctgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaactcatgatttatgaggtcagtaatcggccctcaggggtttctaatcgtcttctctggctccaagtctggcacacggcctccctgaccatctctgggctccaggctgaggacggagggtgatttattactgcagctcatatagaagtaggcagcactctcgtattcggcggtgggaccaagctgaccgtctaggtcagcccaaggcc

SEQ ID NO: 784895 - DNA, 507 bp, Homo sapiens
  misc_feature: HIJSMM301EMNX6.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttcaatcgcttctctggctccaagtctggcaacacggcctccctgaccatctctgggctccaggctgaggacgaggctgattattactgcagctcatatacaagcagcagcactcaagtcttcggaactgggaccaaggtccacgtcctaggtcagcccaaggcccaaccccatcgtcta

SEQ ID NO: 784896 - DNA, 484 bp, Homo sapiens
  misc_feature: HIJSMM301ENLMS.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtggggaccaagctgaccgtcctagg

SEQ ID NO: 784897 - DNA, 502 bp, Homo sapiens
  misc_feature: HIJSMM301ANX2M.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggctagttttattactgtcagcagtattatactactcctctgtacgttcggaccgaagggacctaaggtggagatacaaacgaactggtggctgcaccat

SEQ ID NO: 784898 - DNA, 491 bp, Homo sapiens
  misc_feature: HIJSMM301ERLKH.43.61.F06.1.454.light.4.raw
tgtgagtagtcacgaccggtgctcgatttagctacgctctaagggaaaggggagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggacttgcagtgtatttctgtcaacaatatggtagctcaccgtacacttttaggcctaggggaccaagctagaaatacaaacgaactagtggctgcaccatct

SEQ ID NO: 784899 - DNA, 512 bp, Homo sapiens
  misc_feature: HIJSMM301AUE09.43.33.C11.1.454.light.4.raw
tgtgagtagtcacgaccggtgctcgatttagagtgagctcgttggggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcaactggaaccagcagtgatgttgggagttatagccttgtctcctggtaccaagtgcacccaggcaaagcccccaaactcatgatttatgagggcactaagcggccctcgaggggtttctgatcgcttctctggcttccaagtctggcaacacggcctccctgacaatctctggggctccaggctggaggacgaggctgtattattattgctgctcatatgcaggtagttacacttatgtcttcggaattgggacgcggtcaccgtcctaggtcagcccgaaggccccaaccctacg

SEQ ID NO: 784900 - DNA, 510 bp, Homo sapiens
  misc_feature: HIJSMM301CWLW7.40.12.B01.1.454.light.4.raw
tctagcgactcacgaccggtgctcgatttagtagtgtagattccgcgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgactcagtaagcggccctcaggggtccctgatcgcttctctggctccaagtctggcaacacggcctccctgaccgtctctgggctccaggctgaagatgaggctgattattactgctactcgtatgcaggcgcaacaattgggtcttcggcggagggaccaagctgaccgtctaggtcagcccaagctcgccccctcggtccactctcg

SEQ ID NO: 784901 - DNA, 489 bp, Homo sapiens
  misc_feature: HIJSMM301AVCWR.14.55.E11.1.454.light.4.raw
  modified_base (479)..(479): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtgggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactggtggctgcaccanctgtcttcta

SEQ ID NO: 784902 - DNA, 486 bp, Homo sapiens
  misc_feature: HIJSMM301ETR6F.52.49.E05.1.454.light.4.raw
cgcagtacgacacgaccggtgctcgatttagagcgactagcaacacacaaaggggagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagccctcagctcctgatctttgctgcatccagtttgcacagtggggtcccatcaaggttcagtggcagtggatctgggacagacttcactctcaccatcagcagtctgcaacctgaggtattttgcctacttactactgtcaacagacttaccaactacccctcctatactacttttcggacctacggggaaccaagcgtggaagactacaagacgaact

SEQ ID NO: 784903 - DNA, 525 bp, Homo sapiens
  misc_feature: HIJSMM301EYHWH.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactacctgtcaacagagtttcagtgtcccccggacgttcgccgacgggaccgaccgagtagaaattagaagaacgaacgtacgtggcgttgcgaccacgtaccttgtcttctacttcttccccgt

SEQ ID NO: 784904 - DNA, 514 bp, Homo sapiens
  misc_feature: HIJSMM301CRN3Z.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgacttattactgtttgacttggcacaacaacgcctggatcttcggacctgggaccacggtccaccgtcctaggtcagcccaaggccaacccccactacgttcactctcgttcccccg

SEQ ID NO: 784905 - DNA, 506 bp, Homo sapiens
  misc_feature: HIJSMM301CN4RJ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtacaaacctaccttccggaccgaagggacacgactggagagttaaagaactgtggctgcaccgatctgttcttctattccttccccg

SEQ ID NO: 784906 - DNA, 516 bp, Homo sapiens
  misc_feature: HIJSMM301CQ0PK.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcacgccaaggctcgccccctcggtcactctcgttccccg

SEQ ID NO: 784907 - DNA, 512 bp, Homo sapiens
  misc_feature: HIJSMM301AKDHP.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgatttattactgcagctcataatacaagcagcagcactcaagtcttcggaactgggaccaacggtcaccgttcctaggtcacgcccaacggcccaaccccactcg

SEQ ID NO: 784908 - DNA, 475 bp, Homo sapiens
  misc_feature: HIJSMM301DYDAY.7.81.H04.1.454.light.4.raw
  modified_base (456)..(456): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgctaacttactactgtcaacagagttccactaccccaatcactttcggcctgggactgaatgcatangaagagaactgtaggctgc

SEQ ID NO: 784909 - DNA, 488 bp, Homo sapiens
  misc_feature: HIJSMM301CJHWT.16.68.G02.1.454.light.4.raw
  modified_base (414)..(414): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctacttagaagtgggtcccatcaaggttcagcggcagtggatctgggacagaattcactctcactatcaccagctgcaacctgatgattttgcaacttattactgccaacagtatcntcatcattgtaatttcggtggagggacaaggtgaggtcaacgaactggtgctgcaccatctgtcttcattcccg

SEQ ID NO: 784910 - DNA, 507 bp, Homo sapiens
  misc_feature: HIJSMM301CEJ16.10.79.H02.1.454.light.4.raw
catagtagtgcacgaccggtgctcgatttagtgtcacacgaaggggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctggggacagacttcactctcaccatcagcagactggagtctgaagattttgcagtgtattattgtcagcaatatggtaggtcacctgggaccttttggcctagggggaccaaggcttaggagatacgaaacgaactcgtaggctgcaccatctgtctt

SEQ ID NO: 784911 - DNA, 526 bp, Homo sapiens
  misc_feature: HIJSMM301A25FD.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccggtggacgttcggccgaacgggaccgaaggtaggcaatacaaccgaactcgtggctgcaccatctgtcttctatcttccccg

SEQ ID NO: 784912 - DNA, 494 bp, Homo sapiens
  misc_feature: HIJSMM301D6L3X.10.72.G06.1.454.light.4.raw
catagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcacgcccaac

SEQ ID NO: 784913 - DNA, 522 bp, Homo sapiens
  misc_feature: HIJSMM301EZ6EP.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagccaacattgggacttcagatgtgcactggtaccagcagaagccaggccaggcccctgtactggtcatctttagcgattccaaccggccctctgggatccctgagcgattctctggctccaagtcgggaacacggccaccctgaccatcagcagggcccaacccttggatgaggtgactatttctgtcaagtgtgggacaccaacacttgtgtcgttcgggactgggaccgaggtcaccgtcctaagtcagcccagggccaacccccgactcgtccactctcgttcccgccctcctcgacacg

SEQ ID NO: 784914 - DNA, 504 bp, Homo sapiens
  misc_feature: HIJSMM301APGMR.13.39.D06.1.454.light.4.raw
tcacgtactacacgaccggtgctcgatttagtgacatctcgcagttctttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacggaggctgcctattactgctgctcatatgctaggttcttctgttggtcttcggcggagggtccaaagtgaccgtcctaggtcagcccaaggctcgccccctc

SEQ ID NO: 784915 - DNA, 478 bp, Homo sapiens
  misc_feature: HIJSMM301BDY8E.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaatggatataactatttggattggtatctgcagaggccagggcagtccccacaactcctgatctattgggttctaatcggcctccggggtcctaacaggttcagtggcagtggatcaggcacagattttacactgaaaatcagcagagtggaggctgaggatggttggggtttattactgcatgcaagctctacaacctctgccggacttcggccc

SEQ ID NO: 784916 - DNA, 507 bp, Homo sapiens
  misc_feature: HIJSMM301EHILE.5.24.C02.1.454.light.4.raw
atcagacacgcacgaccggtgctcgatttagtacagatcgttaggggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggccagccagcagtccccatgtgatcttcgggcggggggaccaagctgaccgtcctagatcagcccaaggctcccg

SEQ ID NO: 784917 - DNA, 497 bp, Homo sapiens
  misc_feature: HIJSMM301CNS4U.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaactttactactgtcaacagtagttaccagttacccccctctactttcggcggagggaccaaggtcggaagagtcagacgaactcgtgctgcaccatctgtcttcta

SEQ ID NO: 784918 - DNA, 499 bp, Homo sapiens
  misc_feature: HIJSMM301EASSO.16.86.H09.1.454.light.4.raw
tgtactactccacgaccggtgctcgatttagtgctatagacttgggtttggggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctcctgaccatctctgggctccaggctgaggacgagggtgattattactgcagctcatatagaagtggcagcactctcgtattcggcggtggaccaagctcgaccgtcctaggtcagcccaaggtcccg

SEQ ID NO: 784919 - DNA, 508 bp, Homo sapiens
  misc_feature: HIJSMM301CF4W1.4.57.F02.1.454.light.4.raw
  modified_base (501)..(501): a, c, t, g, unknown or other
agcactgtagcacgaccggtgctcgatttagctcgatataggttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccacctgaccatcagcagggtcgaagccggggatgaggccgactattactgtcaggtgtgggatagtagtggtgatcatccatacgtcttcggaactgggaccaaggtctcgtcctacgcagcccaaggcccaacccactgtcactctnttcccgt

SEQ ID NO: 784920 - DNA, 569 bp, Homo sapiens
  misc_feature: HIJSMM301A4ZNT.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgatttattactgcagctcatatgctaggtttggtttcccttcttttacaaaggattaacgtttcgggccgggtaaggggaccctaagggccttacggaccccgttcccgtggtaacggttccaacggtacccccaaaaggggtccctccggtccccccccccg

SEQ ID NO: 784921 - DNA, 499 bp, Homo sapiens
  misc_feature: HIJSMM301EKR26.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggtccaggggccaaggctggagtatcaaacgaactgtggctgcaccatctgtt

SEQ ID NO: 784922 - DNA, 516 bp, Homo sapiens
  misc_feature: HIJSMM301DES0K.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacgaggggacagcattatttgggtgttcgggcggagggaccaagctgaccgtcctgcgtcagcccaaggctgccccctcggtcacttcc

SEQ ID NO: 784923 - DNA, 319 bp, Homo sapiens
  misc_feature: HIJSMM301AH5JQ.41.78.H01.1.454.light.4.raw
tctatactatcacgaccggtgctcgatttagtgtgagtagtttgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacaggaggccaggccacggcccctgtggtggtcgtccatgatgattacgaccggccctcgaggaact

SEQ ID NO: 784924 - DNA, 494 bp, Homo sapiens
  misc_feature: HIJSMM301A41SV.43.86.H09.1.454.light.4.raw
tgtgagtagtcacgaccggtgctcgatttagtgctatagacttgggtttgggggatcaggactcctcagttcaccttctcacaatgaggctccctgctcagctcctggggctgctaatgctctgggtcccaggatccggtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtgctgcac

SEQ ID NO: 784925 - DNA, 490 bp, Homo sapiens
  misc_feature: HIJSMM301ENN7T.17.21.B10.1.454.light.4.raw
  modified_base (50)..(50): a, c, t, g, unknown or other
cgtagactagcacgaccggtgctcgatttagtgtcgtcgcaaggggactnatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaagcgtcttatttataaggtctctgaccgggactctggggtcccagacagattcagcggcagtgggtcagacactgatttcacactgaaaatcagcgagggtggaggctgaggatgtcggggttactactgcatgcagggtacactctggccgttctacttttggcctaggggaccaaactggatatcagacaactgtggctgca

SEQ ID NO: 784926 - DNA, 495 bp, Homo sapiens
  misc_feature: HIJSMM301EIIU9.49.82.H05.1.454.light.4.raw
agtcgagagacacgaccggtgctcgatttagtcgagctctctcgcgggcacgaccggtgctcgatttagtctgacgtcaaagggaaaggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttgagatggtatcaacagaaaccagggaaagccctaaactcctgatctatgctacattcgtttacaaagtgggtcccatcaaggttcagtggcagtggatctgggacagattcactctcaccatcagcagtctgcaacctgaagattttgctaacttactactcgtcaacagagttacagtaccccctattccactttccggccctcgggaccctaaagta

SEQ ID NO: 784927 - DNA, 503 bp, Homo sapiens
  misc_feature: HIJSMM301DUMFF.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcacccatcaatagcctggaagctgaagatgctgcaacttattactgtcatcagatactactttacctcaatgatccaccttcggccaagggacacgactggagattaaacg

SEQ ID NO: 784928 - DNA, 551 bp, Homo sapiens
  misc_feature: HIJSMM301C809N.43.33.C11.1.454.light.4.raw
tgtgagtagtcacgaccggtgctcgatttagagtgagctcgttggggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagacagggcaacctcctcaacttctgatataccgttcatcgctgttgcacgttggggtcccacctcggttcagtggcaacggctctgagacagtatttttctctcgtcatcactggtctacagtctgacgacggcgcaatgtacttctgtcaacactatcgcccttcctaccccccctactaacgttttccggtacgacgggggtaacccaaaggtttagaaaccattaccaaaacttccggaaaaccttggttagggtccttcggccctaacccaacgttcctttcg

SEQ ID NO: 784929 - DNA, 504 bp, Homo sapiens
  misc_feature: HIJSMM301ECKLX.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtccgtaggtccacgcccgaacggcctcgccccctcggtcctacc

SEQ ID NO: 784930 - DNA, 507 bp, Homo sapiens
  misc_feature: HIJSMM301CZA3Z.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctctcatctatggtgaatccaacagggccactggcatcccagacaggttcagtggcagtgggtctgggacagacttcactctcacatcagcagactggagcctgaggattttgcagtgtattactgtcagcagtatcataggtcaaacaccttcggaccaagggtacacggaacctggagaagttaaaggaactggtggctagctaccatcttgtcttcacttcttcccccgg

SEQ ID NO: 784931 - DNA, 501 bp, Homo sapiens
  misc_feature: HIJSMM301EG7VK.11.1.A01.1.454.light.4.raw
cgagagataccacgaccggtgctcgatttagacgtctcatcaaggaagggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcgagcagcctgcagactgaagatgtgggcgtttattattgtcaacaatattctcttgttccgtttaatttcggcggtagggaccaaggtggagatcaaacgaactgtgctgcaccatctgtcttcatctcccgcat

SEQ ID NO: 784932 - DNA, 516 bp, Homo sapiens
  misc_feature: HIJSMM301EUQ8U.16.1.A01.1.454.light.4.raw
tgtactactccacgaccggtgctcgatttagacgtctcatcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctcgaccgtcctaggtcacgcccaaggctcgccccctcggtcactctcttcccc

SEQ ID NO: 784933 - DNA, 464 bp, Homo sapiens
  misc_feature: HIJSMM301ESJWY.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaacccactgtcactctgttcccaccctcctccatactcgta

SEQ ID NO: 784934 - DNA, 508 bp, Homo sapiens
  misc_feature: HIJSMM301DQKGL.19.85.H08.1.454.light.4.raw
tactctcgtgcacgaccggtgctcgatttagtatcactcagtcgcgggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgtctcagcctgggacaccagcctcgctgcttggcttttcggcggtagggaccaagctgaccgtcctggtcagcccaaggctgccccctcgtccgta

SEQ ID NO: 784935 - DNA, 531 bp, Homo sapiens
  misc_feature: HIJSMM301CT1RE.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttgggggcaaagctgccctgacactgtctggtgtgcagcctgaggacgaggctgactattactgcctactctactttggtggtgctgtgctattcggcggagggaccaaggctgtaccgtctttaacggtctaagccccaagggctcgtccccctcggtccactctcgttcccctacccctccctt

SEQ ID NO: 784936 - DNA, 509 bp, Homo sapiens
  misc_feature: HIJSMM301AQYHQ.18.78.H01.1.454.light.4.raw
tacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgatttattactgcagctcatatacaagcagcagcactcaagtcttcggaactgggaccaaggtcacgtcctaggtcagcccaaggccaacccacctagtcta

SEQ ID NO: 784937 - DNA, 524 bp, Homo sapiens
  misc_feature: HIJSMM301BTPRK.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtctaagtgtgggacaccaacacttgtgtcttcggggactgggaccgaggtcaccgtcctaagtcagcccagggcccaaccccactcgtcactctgttccccaccctcctcgacaccg

SEQ ID NO: 784938 - DNA, 522 bp, Homo sapiens
  misc_feature: HIJSMM301C144H.10.28.C06.1.454.light.4.raw
catagtagtgcacgaccggtgctcgatttagagctcacgtattgggtttgggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgacctcagggtttctgatcgcttctttgcctccaagtctggcaacacggcctccctgaccatctctgggctccagactgaggacgaggctgattattactgcagctcacatacaagcggcagcggttgggtgttcgggcgggggaccacgacgtgaccgtccgtaggtcagacccaaggctcgccccctcggtcactctgttccccc

SEQ ID NO: 784939 - DNA, 498 bp, Homo sapiens
  misc_feature: HIJSMM301EYW1Z.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcgaggggtttctaatcgcttctctggctccaagtctggcaacacggcctccctgacaatctctgggctccaggctgaggacgaggctgattactactgctgctcatatgcaggtcgtattctcttatgtcttcggaactgggaccaaggtcaccgtctaggtcagcccaaggccaaccca

SEQ ID NO: 784940 - DNA, 507 bp, Homo sapiens
  misc_feature: HIJSMM301EFI68.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattattctgcggctcattatggagacaattacagctttgctttcggaagtgggaccaaggtcaccgtcctaagtcagcccaaggccaaccccgactcgtcactcctgttcccaccct

SEQ ID NO: 784941 - DNA, 488 bp, Homo sapiens
  misc_feature: HIJSMM301A81BH.7.81.H04.1.454.light.4.raw
cgtgtctctacacgaccggtgctcgatttagtagtgtagattcgcgggggagtcaatctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaaattggtatcagaagaaacccaggaaaaagcccctaaactcctgatctctgctgccgccagtttgcaaagtggggtcccatcaagattcagtggcagtggatctgggacagattttcactctcgccatcagtagtctgcaacctgatgattttgcaacttactactgtcaacagagttccactaccccaatcactttcggcctgggactggaagtgacatatagaacgagaaactcgtggtcgtgcaa

SEQ ID NO: 784942 - DNA, 513 bp, Homo sapiens
  misc_feature: HIJSMM301ENTT1.10.33.C11.1.454.light.4.raw
catagtagtgcacgaccggtgctcgatttagagtgagctcggttggggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcgatcgaacttggaaacaggggtcccatcaaggttcagtggaggtggatctgggacagattttactctcggcatccgcagcctgcagcctgaagattttgcacatattacttgtcaacaagtatgaaaatagtcccgctcactttcggcggggggaccgaaggtggaggttcaaacgaactagtggtactgcaccgatctgtcttactacttcccg

SEQ ID NO: 784943 - DNA, 494 bp, Homo sapiens
  misc_feature: HIJSMM301AEQAQ.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggacctaagtaacatcgtcttcggaactcgggacaaggtcaccgtccg

SEQ ID NO: 784944 - DNA, 516 bp, Homo sapiens
  misc_feature: HIJSMM301CUF6W.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccggtcctaggtcagcccaaggccaacccactgtcactctgttcccaccctccc

SEQ ID NO: 784945 - DNA, 488 bp, Homo sapiens
  misc_feature: HIJSMM301EB16U.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctaccagcgttcggccaggggaccaaggtggaagtcaagcgaactgtgctgcacatctgtt

SEQ ID NO: 784946 - DNA, 490 bp, Homo sapiens
  misc_feature: HIJSMM301ECW2X.41.2.A02.1.454.light.4.raw
tctatactatcacgaccggtgctcgatttagactcatctacagggggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatcttaggttccgtggaagtggatcgtgggacagactttactctcaccattagcagcctggagcctgaagatattgcaacatattactgtcaacagtctcatggtctcccctttagtttcggcggagggaccgaaggttgagatcaaacgaactgtggctgcacatctgtcttcatt

SEQ ID NO: 784947 - DNA, 488 bp, Homo sapiens
  misc_feature: HIJSMM301EQLRO.7.67.G01.1.454.light.4.raw
  modified_base (479)..(479): a, c, t, g, unknown or other
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacacgcccccaaactcctcatatacgagaacaccaatcggccctcaggagtccctgaccgattctctggctccaagtctggcacctcagcctccctggcccatcactgggctccaggctgaggatgaggctgattattactgccagtcgtatgaaccagcagcctgagttgtttgggtgttcgggcggngggaacccg

SEQ ID NO: 784948 - DNA, 469 bp, Homo sapiens
  misc_feature: HIJSMM301A0CE1.5.70.G04.1.454.light.4.raw
  modified_base (462)..(462): a, c, t, g, unknown or other
atcagacacgcacgaccggtgctcgatttagtgtagtgtgaagggaaagggggcaggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtgggtccatcaaggttcatcggcagtggatctgggacagatttcactctcaccatcagcagcctgcagcctgaagatttgcaacttactttgtcaacaggctcagagtttcccgctcactttcggcggagggaccaagggtggagatnaaacgaa

SEQ ID NO: 784949 - DNA, 527 bp, Homo sapiens
  misc_feature: HIJSMM301AF17T.21.81.H04.1.454.light.4.raw
  modified_base (359)..(359): a, c, t, g, unknown or other
  modified_base (437)..(437): a, c, t, g, unknown or other
  modified_base (444)..(444): a, c, t, g, unknown or other
  modified_base (495)..(495): a, c, t, g, unknown or other
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacncggcctccctgaccatctctgggctccaggtctgatgacgaggctgatttatactgcaggtcatatacaatcagcaanacttatntcgttcggtacgtcggtaccgaacgatacaccgttacccgtacggttacgngacccgaacgccgaacccccactacgtctacc

SEQ ID NO: 784950 - DNA, 531 bp, Homo sapiens
  misc_feature: HIJSMM301ATA11.41.35.D02.1.454.light.4.raw
tctatactatcacgaccggtgctcgatttagcacacgatagttgggtttgggggtgctcgattagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtgggtcccatcaaggttcagcggcagtggatctgggacacatttcactctcactatcagcagcctgcagcctgaggtattttgcgacttactattgtctaacaggctgactacgtttaccctcttcctacgtttcggtacgggacggggaccgtaaagggttcgaagtacccaaaacggaacctta

SEQ ID NO: 784951 - DNA, 505 bp, Homo sapiens
  misc_feature: HIJSMM301A8RC9.51.39.D06.1.454.light.4.raw
cgatcgtatacacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttacggactgggaccaaggtccaccgtcctaggtcacgacccaagcccaaccccactgtccactttcc

SEQ ID NO: 784952 - DNA, 509 bp, Homo sapiens
  misc_feature: HIJSMM301BOBFN.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctctacttcggcggagggaccgaggtggagaatacaaacgaactggtggctgcacatctgttc

SEQ ID NO: 784953 - DNA, 518 bp, Homo sapiens
  misc_feature: HIJSMM301ADIEA.10.27.C05.1.454.light.4.raw
catagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagactcatatgtagatggtgccttctttctaaggttttcggcgggagggaccgaggcgtcgacccgtcctaagtcacgcccaaggcctcgccccctcggt

SEQ ID NO: 784954 - DNA, 506 bp, Homo sapiens
  misc_feature: HIJSMM301CVXFX.3.79.H02.1.454.light.4.raw
agacgcactccacgaccggtgctcgatttagtgtcacacgaagggaaagggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaacgcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggaggacaagctgaccgtctaggtcagcccaaggctcgccccctcggt

SEQ ID NO: 784955 - DNA, 495 bp, Homo sapiens
  misc_feature: HIJSMM301ATEL8.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggcgtgaggatgttggggtttgttcctccatgcaaggtacacactggtcctttggccaggggaccaacctggagatcaaatgaactgtggcgtgcaccatctgtctt

SEQ ID NO: 784956 - DNA, 525 bp, Homo sapiens
  misc_feature: HIJSMM301AJ1FW.40.12.B01.1.454.light.4.raw
  modified_base (451)..(451): a, c, t, g, unknown or other
tctagcgactcacgaccggtgctcgatttagtagtgtagattccgcggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcgcaacaattgggtcttcggnggagggaccaagctcgaccgtcctaggtccagcccgaaggcctcgcccccgtcggttccacttctcgttcccca

SEQ ID NO: 784957 - DNA, 522 bp, Homo sapiens
  misc_feature: HIJSMM301AMBEZ.17.33.C11.1.454.light.4.raw
  modified_base (435)..(435): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtnctattcggcggagggaccaagctgaccgtcttaagtcagcccaaggctcgccccctcggtccactctcgttcccaccctccttaccg

SEQ ID NO: 784958 - DNA, 505 bp, Homo sapiens
  misc_feature: HIJSMM301EO6W0.22.14.B03.1.454.light.4.raw
  modified_base (405)..(405): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggctctacccgggaatccggggtccctgaccgattcagtggcagcgggtctgggacagatttcactctcaccatcagcagcctgcaggctgaagatgnggctagttttattattgtcagcaattattatattccctcctcagtacgttcggccaagggaccaaggtggaaatacaaacgaactggtggctgccaccta

SEQ ID NO: 784959 - DNA, 444 bp, Homo sapiens
  misc_feature: HIJSMM301E3YQQ.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctcaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttccccaccctcctcagacgtatca

SEQ ID NO: 784960 - DNA, 478 bp, Homo sapiens
  misc_feature: HIJSMM301BB1QG.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggagcacagcctccctgaccattactggactccagctgacgacgaagctgattattactgctcagtcatgggacaccggcctcagtgcgtgggtttcggcggaggccaagctgaccgtctaggtcagcccg

SEQ ID NO: 784961 - DNA, 504 bp, Homo sapiens
  misc_feature: HIJSMM301DXWTO.49.84.H07.1.454.light.4.raw
agtcgagagacacgaccggtgctcgatttagcagacgtctgtcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagccggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtctaggtcagcccaaggctcgccccctcggt

SEQ ID NO: 784962 - DNA, 497 bp, Homo sapiens
  misc_feature: HIJSMM301APK88.41.35.D02.1.454.light.4.raw
tctatactatcacgaccggtgctcgatttagcacacgatagttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccagtctggcaacacggcctccctgaccatctctgggctccgaggctgaggacgaggctgattattactgcagctcatatacaagcagcagcactctcgtggtattcggcggagggaccaagctgaccgtcctaggtcagcccaaggct

SEQ ID NO: 784963 - DNA, 525 bp, Homo sapiens
  misc_feature: HIJSMM301BLOCJ.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcacgtccccagtcgtgatcgttcgggcggggggtaccgaagctcggaccgtccgtacggtcgacgcccgaaggctccgtcccccccg

SEQ ID NO: 784964 - DNA, 495 bp, Homo sapiens
  misc_feature: HIJSMM301DWMFL.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcaagcagacaacagtaatacttatctttatgttcttcggattcgtgggaccagggtccaccgtcctaggtcagcccaaggcccaacccc

SEQ ID NO: 784965 - DNA, 510 bp, Homo sapiens
  misc_feature: HIJSMM301BR9M7.5.24.C02.1.454.light.4.raw
atcagacacgcacgaccggtgctcgatttagtacagatcgttaggggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaacgcccccaaactcatcatttttgaggtcactacgcgaccctcaggggtccctgatcgcttctctggctccaagtctggcaacacggcctccctgaccgtctctcgggctccaggctgaggatgaggctgattattactgcagctcatatgcaggcagcagcacgtccccatgtgatcgttcgggcggggggaccaagctgccgtctaggtcagccaaggctcgcccccg

SEQ ID NO: 784966 - DNA, 442 bp, Homo sapiens
  misc_feature: HIJSMM301A8PP5.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggcccctggggtccctgaccgatctctggctccaggtctggcgcctcagcctccctggtcattagtgggctccagtctgacgatgaggctgactattactgttcagcgtggggatgccagcccgaatcattgggtgttcggcggagggaccaaactgaccgtcctaggtcagcccaaggctgccccctcggtcactctcgttccccgccctcctcatagtataga

SEQ ID NO: 784967 - DNA, 502 bp, Homo sapiens
  misc_feature: HIJSMM301A42VQ.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctggtcagcccaaggctgccccctcggtcc

SEQ ID NO: 784968 - DNA, 493 bp, Homo sapiens
  misc_feature: HIJSMM301EOVFT.27.78.H01.1.454.light.4.raw
  modified_base (491)..(491): a, c, t, g, unknown or other
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtccctcgaggttcagtggcagtggatctgggacacatttcaccctcaccatcaatagcctggaagctgaagatgctgcaacttattactgtcatcagagtacttactttacctcaagtgatcaccttcgccagggacacgactggagattaaacgaactgtcgctgcaccatctntt

SEQ ID NO: 784969 - DNA, 486 bp, Homo sapiens; identical to SEQ ID NO: 546671
  misc_feature: HIJSMM301DPMH9.26.78.H01.1.454.light.4.raw

SEQ ID NO: 784970 - DNA, 522 bp, Homo sapiens
  misc_feature: HIJSMM301D1Z4S.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttctcgggcgttcggccgtaagggaccaaggtacggaaagtacgaaacgaaactgtaggctgcgtaccatactcgtcttcgtactcctttccccg

SEQ ID NO: 784971 - DNA, 484 bp, Homo sapiens
  misc_feature: HIJSMM301B162C.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcggcctccggggtccctgacaggttcagtggcagtggatcaggcacagattttacactagaaaatcagcagagtggaggctgaggatgttgggctctattattgcatgcaagctctacaagtcccgctcacgtttcggcggaggaccaaggtggagatcaaacgaa

SEQ ID NO: 784972 - DNA, 521 bp, Homo sapiens
  misc_feature: HIJSMM301AJPIH.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccgaggctgaccgtcctaggtcagcccaaggctgccccctcggtcactctgtcccgccct

SEQ ID NO: 784973 - DNA, 483 bp, Homo sapiens
  misc_feature: HIJSMM301AI57J.21.25.C03.1.454.light.4.raw
  modified_base (451)..(451): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgccacagctgaagcagagcctccaaactcctcatctatggtaacagcaatcggccctcaggggtccctgaccgattctctggctccaagtctggcacctcagcctccctggtcatcgctgggctccaggcctgacgatgaggctgattattattgccagtcctatgacaacacccngcgttggttttggtctgttcggcggcggaccg

SEQ ID NO: 784974 - DNA, 503 bp, Homo sapiens
  misc_feature: HIJSMM301EIFGI.48.10.A10.1.454.light.4.raw
agtatacatacacgaccggtgctcgatttagcgtcgatctcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgattgattttgctaacttatttctgccaacagtatcatacttattctcggaccttcggaccgagggaccgagggtaggaaattacaaacgaactggtaggtctcggtcacctactcttcggtcttactatt

SEQ ID NO: 784975 - DNA, 495 bp, Homo sapiens; identical to SEQ ID NO: 554351
  misc_feature: HIJSMM301E2C1C.51.81.H04.1.454.light.4.raw

SEQ ID NO: 784976 - DNA, 503 bp, Homo sapiens
  misc_feature: HIJSMM301ELZ7C.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggactgggaccaaggtcaccgtcctaggtcagcccaaggcccaaccccactcgtcactctagttccccaccctcctccacgacgagta

SEQ ID NO: 784977 - DNA, 484 bp, Homo sapiens; identical to SEQ ID NO: 535211
  misc_feature: HIJSMM301DT0AB.47.46.E02.1.454.light.4.raw

SEQ ID NO: 784978 - DNA, 520 bp, Homo sapiens
  misc_feature: HIJSMM301CUA5N.19.59.F04.1.454.light.4.raw
  modified_base (507)..(507): a, c, t, g, unknown or other
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattaccgtgcggaacatggggataggcagcctgagtctgtgataatcggaggagggacccaagctgaccgtctacggtcagcccaaggctcgccccctcggtaccnctcctgttcccta

SEQ ID NO: 784979 - DNA, 500 bp, Homo sapiens
  misc_feature: HIJSMM301CLTD2.13.36.D03.1.454.light.4.raw
  modified_base (498)..(498): a, c, t, g, unknown or other
tcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctcctgacaatctctggactccgaggccgaggacgaggctgtatttttactgttgttcatatgcaggaaggagtgattatgttcttggaagtgggaccaaggtcacgtcctggtcagccaaggccaacccnct

SEQ ID NO: 784980 - DNA, 500 bp, Homo sapiens
  misc_feature: HIJSMM301BGECZ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacaggacttcactctcaccatcagcagactggagcctgaggatttttgcagtgtattactgtcagcagtatcataggtcaaacaccttcggaccaagggacacgactaggagaattaaaggaactgtggctgcaccatctgtcttctatcttccccg

SEQ ID NO: 784981 - DNA, 537 bp, Homo sapiens
  misc_feature: HIJSMM301BQPYV.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctggaggacgaggctgacttattactgcctactctactttggtggtgctgtgctagttcggcggagggaccaagcgtgaccggttcttaaaggtcacgccccgaaggccttcgcccccctcggttccactcctcgttcccccaccccttcct

SEQ ID NO: 784982 - DNA, 502 bp, Homo sapiens
  misc_feature: HIJSMM301CHX7J.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcagggtttctaatcgcttctctggctccaagtctggcaacacggcctccctgaccatctctggctccaggctgatgacgaggctgattattactgcaggtcatataacaatcagcaacacttatgtcttcgggactgggaccagatcaccgtcctaggtcagcccaaggcccaaccccactgtcta

SEQ ID NO: 784983 - DNA, 514 bp, Homo sapiens
  misc_feature: HIJSMM301EOKZV.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaagctgccctgacactgtctggtgtgcagcctgaggacgaggctgactattactgcctactctactttggtggtgctgtgcttattcgggcggagggaccaaggctgaccgtcttaagtcagcccaaggctcgccccctcggtccactctgttcccg

SEQ ID NO: 784984 - DNA, 486 bp, Homo sapiens
  misc_feature: HIJSMM301EY0S6.19.57.F02.1.454.light.4.raw
  modified_base (466)..(466): a, c, t, g, unknown or other
  modified_base (482)..(482): a, c, t, g, unknown or other
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatccttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcacgactgaaagattttgcaacttatttttgtctaacaggactaacacttccctccacttcggtcgacggacgacgtaggagagtanacgagtacgagttggngtcg

SEQ ID NO: 784985 - DNA, 509 bp, Homo sapiens
  misc_feature: HIJSMM301DODNT.16.1.A01.1.454.light.4.raw
tgtactactccacgaccggtgctcgatttagacgtctcatcaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaacgcccccaaactcatcatttatgaagtctctaagcggccctcaggggtatctaatcgcttctctggctccaagtctggcaacacggcctccctgaccgtctctggcctccagactgaggacgaggctgattattactcgccactcatatagaagtagtactactcctgttggtttcggcggaggaccaagctgaccgtcctaggtcagccagctcgccctcgtcactctcgttccccg

SEQ ID NO: 784986 - DNA, 512 bp, Homo sapiens
  misc_feature: HIJSMM301AEQ01.22.73.G07.1.454.light.4.raw
acatacgcgtcacgaccggtgctcgatttagctctacgctcagggggaggaactgctcagttaggacccagacggaaccatggaagcccccagcgcagcttctcttcctcctgctactctggctcccagataccactggagaaatagtgatgacgcagtctccagccaccctgtctgtgtctccaggggaaagagccacccctctcctgcagggccagtcagagtgttagcaacaacttagtctggtaccagcagagacctggcccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttcttcggatctacccttcggcccaacgggacgaccgaactaggacgagttaaacgtaactagtaggcgtgcgaccactactcgttcc

SEQ ID NO: 784987 - DNA, 484 bp, Homo sapiens
  misc_feature: HIJSMM301BFPB6.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatatatagtactcctccgaggctcactttcggcggagggaccaaggtgagatacaaacgaa

SEQ ID NO: 784988 - DNA, 502 bp, Homo sapiens
  misc_feature: HIJSMM301CJK59.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgagggacgaggctgattattactgcagcttatatacaggcaacaatacttttgtcttcggaactgggaccaaggtcaccgtcctaggtcagccaaggccaacccactgt

SEQ ID NO: 784989 - DNA, 534 bp, Homo sapiens
  misc_feature: HIJSMM301AJCEL.12.21.B10.1.454.light.4.raw
atacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctggctccaggctgaggacgaggctcattactacttgctgctcatatggaggttatagcacgttgggtgttcgggcggcgggaccgaaagtgaccgtcctaagtcagcccaaggctcgccccctcggtccactcctgttccccgcccttcccc

SEQ ID NO: 784990 - DNA, 508 bp, Homo sapiens
  misc_feature: HIJSMM301A345L.12.12.B01.1.454.light.4.raw
atacgacgtacacgaccggtgctcgatttagtagtgtagattccgcgggggtgggctcaggagggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagctgcattgccaataaaatctccttattggtaccagcagaagtcaggccaggcccctgtattggtcatctatgaggacaacagacgaccttccgggatccctgagagattctctggctccacctcagggacaatggccaccttgactatcagtggcgcccaggtggaggatgaggctgactactatttgttattcaacagacagcactacaagtcattgggtgttcggcggagggaccaagctgaccgtcctacgtcagcccaaggctcgccccctcggcactctgttccccg

SEQ ID NO: 784991 - DNA, 494 bp, Homo sapiens
  misc_feature: HIJSMM301D2F4B.49.42.D09.1.454.light.4.raw
agtcgagagacacgaccggtgctcgatttagacacatacgcagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcgggacgggaccgaaggtggagatacaaacgaactgtggctgcaccatctgtt

SEQ ID NO: 784992 - DNA, 509 bp, Homo sapiens
  misc_feature: HIJSMM301CWHPO.53.10.A10.1.454.light.4.raw
  modified_base (270)..(270): a, c, t, g, unknown or other
  modified_base (389)..(389): a, c, t, g, unknown or other
cgcgtatacacacgaccggtgctcgatttagcgtcgatctcaggggctgggcctcaggaagcagcatcggaggtgcctcagccatggcatggatcccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagagccaggcctgtcccctntgttggtcatgtatcaagataacaagcggccctctggcatccctggggcattctctggcctccaactctgggaacacagccactctgaccatcagcggacccagactatggatgaggcngactattactgtcaggcatggacagcgtaaattgcggtgttcgggcgggggtaccaaacgtcgaccgtacctaggtcacgcccaaggccgtcgccccccgtcggtccacctcttccgttt

SEQ ID NO: 784993 - DNA, 508 bp, Homo sapiens
  misc_feature: HIJSMM301EE1VS.40.35.D02.1.454.light.4.raw
tctagcgactcacgaccggtgctcgatttagcacacgatagttgggtttgggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggcttacttatttttgcttgctcttatgcgaggctagtttcgacttctcgtaaggtgtttcgggcgggacggggaccgacgcgtcgacccgtcctacgttcacgg

SEQ ID NO: 784994 - DNA, 520 bp, Homo sapiens
  misc_feature: HIJSMM301BI6S1.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcgggagggaccaagctgaccgtcctaagtcagcccaaggctcgccccctcggtcactctcgttccccaccctcctacg

SEQ ID NO: 784995 - DNA, 490 bp, Homo sapiens
  misc_feature: HIJSMM301CFZ8K.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggcctcaggggtttcaatcgcttctctggctccaagtctggcaacacggcctcctgaccatctctgggctccaggctgaggacgagtctgattattattgcagctcatatgcacctggcagcaatcatgtggttttcggacggggggaccaaggtgaccgtcgtaggtcagcccg

SEQ ID NO: 784996 - DNA, 504 bp, Homo sapiens
  misc_feature: HIJSMM301EYXOQ.15.59.F04.1.454.light.4.raw
tctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggccccaggcagatgatgaatctgtttattattgtgtcctatatatgggtgctggcatttcggtcttcggcggagggaccaagctgaccgtctaggtcacgccaaggctcgccccctcggt

SEQ ID NO: 784997 - DNA, 300 bp, Homo sapiens
  misc_feature: HIJSMM301AYH33.49.15.B04.1.454.light.4.raw
agtcgagagacacgaccggtgctcgatttagacagtatatatccgcgggcacgaccggttctcgatttagacagtatatatccgcgggcacgaccggtgctcgatttagacgacagctcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgact

SEQ ID NO: 784998 - DNA, 507 bp, Homo sapiens
  misc_feature: HIJSMM301AWQRS.41.14.B03.1.454.light.4.raw
  modified_base (499)..(499): a, c, t, g, unknown or other
tctatactatcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaaactcatgatttatgatgtcagtaatcggccctcaggggtttctaatcgcttctctggctccaagtctggcaacacggcctccctgaccatctctgggctccaggctgaggacgaggctgattattactgcagctcatataacaagcagcagcactctcgtggtattcggcgggagggaccaagctagaccgtcctaggtcacgccaacggcngccccctc

SEQ ID NO: 784999 - DNA, 523 bp, Homo sapiens
  misc_feature: HIJSMM301EDLCY.10.75.G09.1.454.light.4.raw
catagtagtgcacgaccggtgctcgatttagtatagacatcagggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagccccccaaaattatcatttctgctgtcagtaatcggccctcaggggtttctagtcgcttctctggctccaagtctggcaacacggcccccctgaccatctctgggctccaggctgaggacgaggctgattattattgcagctcatatacaaacaaccaaagctttgatattcggcggagggaccaaaactgaaccggtcctcgtcagcccacggactgccccctccggtcgactctcgttcccaccct

SEQ ID NO: 785000 - DNA, 496 bp, Homo sapiens
  misc_feature: HIJSMM301EO539.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagccccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgtcctgagtcagcccaaggctcg

SEQ ID NO: 785001 - DNA, 496 bp, Homo sapiens
  misc_feature: HIJSMM301AMY55.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggctccacggtacacttttggccaggggaccaagctggagatcaaacgaactgtggctgcaccatctgtt

SEQ ID NO: 785002 - DNA, 519 bp, Homo sapiens
  misc_feature: HIJSMM301AJJ9M.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgcccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaatctggcaacacggcctccctgaccatctctgggctcgagtctgaggacgaggctgattacttctgttgctcttgggcaactacttgtcgtttgggtgttcggcgggagggaccagttgaccgtcctaggtcagcccaaggctcgccccctcggtccactctcgttcccccg

SEQ ID NO: 785003 - DNA, 512 bp, Homo sapiens
  misc_feature: HIJSMM301B43UM.48.37.D04.1.454.light.4.raw
agtatacatacacgaccggtgctcgatttagtagcatactgttgggtttgggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactcctggactttcggccaagggaccaaggtaggaaatacgacgacgaaaccgtggtggtctggaccaccta

SEQ ID NO: 785004 - DNA, 524 bp, Homo sapiens
  misc_feature: HIJSMM301DBCIT.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgctagtttattactgtcaacatcgtaccgagtcggccgtccgggggcctacgtttccggcccgtcgggaccgaaaggtggatattacaaacgaactgtgcgtgtccacactctgttcgttcta

SEQ ID NO: 785005 - DNA, 511 bp, Homo sapiens
  misc_feature: HIJSMM301A8IZS.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggcctccaggctgaggatgaggctgattattactgcagctcatatgcaggcagcagcagtccccatgtgatcttcgggcggggggaccaagctgaccgtcctaggtcagcccaaggctcgtccccccg

SEQ ID NO: 785006 - DNA, 493 bp, Homo sapiens
  misc_feature: HIJSMM301E2ZTJ.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggccacgggaccgaaggtaggaagtacaaacgaactagtggcgtgcaccatctgtctt

SEQ ID NO: 785007 - DNA, 512 bp, Homo sapiens
  misc_feature: HIJSMM301CMRM3.19.67.G01.1.454.light.4.raw
  modified_base (353)..(353): a, c, t, g, unknown or other
tactctcgtgcacgaccggtgctcgatttagagtatacatattggggtttgggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgattcggttctctggctccatcganagctcctccaactctgccctccctcaccatctctggactgaagactgaggacgaggctagactactactgtcagtcttatgatgccgcggtcatgtggtcgttcggcgggagggaccaaggctgaaccgtcctaggtcagccctaaggctcgccccctc

SEQ ID NO: 785008 - DNA, 495 bp, Homo sapiens
  misc_feature: HIJSMM301A2S87.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctctactttcggcggagggaccgagggtcggagatcagacgaactgtggcgtgcaccatctgtt

SEQ ID NO: 785009 - DNA, 519 bp, Homo sapiens
  misc_feature: HIJSMM301EH5OB.5.24.C02.1.454.light.4.raw
atcagacacgcacgaccggtgctcgatttagtacagatcgttagggaaagggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctcaagtctggcaacacggcctccctgaccgtctctgggctccaggctgaggatgaggctgattattactgcagctcatatgcaggcagcagccacgtccccattgtgattcgttcgggcggggggaccaagtctcgaccgtcctaggtccagcccaaggcctcgtccccccg

SEQ ID NO: 785010 - DNA, 518 bp, Homo sapiens
  misc_feature: HIJSMM301D8CD3.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccagggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatatttttgtcaggtgtgggagactaattttggtcatatgttgttcggcggagggaccaagctgaccgtcctcggtcagcccaaggctgccccctcggtcactctcgttcccgccctcct

SEQ ID NO: 785011 - DNA, 508 bp, Homo sapiens
  misc_feature: HIJSMM301DJHYZ.40.26.C04.1.454.light.4.raw
tctagcgactcacgaccggtgctcgatttagtctagcgactttgggtttgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatccttccccg

SEQ ID NO: 785012 - DNA, 525 bp, Homo sapiens
  misc_feature: HIJSMM301C8IUI.15.86.H09.1.454.light.4.raw
  modified_base (401)..(401): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatcctccaacctccagtctgacgatgaggctgagtatcactgtggagagagccanacaattgatggaccaaggacggttggggtgttcgggcggagggaccaagctagaccgtcctaggtcaacgcccaaggctcgccccctggtcactctcgttccccgcccttccgtcgtcctacgt

SEQ ID NO: 785013 - DNA, 494 bp, Homo sapiens
  misc_feature: HIJSMM301APWIE.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttatactgcatgcagggtacactctggccggttcaacttttggccaggggacccgaaactggatatcagacgaactgtcggctgca

SEQ ID NO: 785014 - DNA, 490 bp, Homo sapiens
  misc_feature: HIJSMM301DQ1VG.40.36.D03.1.454.light.4.raw
  modified_base (476)..(476): a, c, t, g, unknown or other
tctagcgactcacgaccggtgctcgatttagctgcgtcacgatctctcttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcaggcgggtctgggacagtattttactctcaccatcagtagcctgcaggctgaagatgtggctagtttattactgtcaacaatattattatactccgcgacgtcggccgggacgacgtagaanacaacgaactagtg

SEQ ID NO: 785015 - DNA, 498 bp, Homo sapiens
  misc_feature: HIJSMM301CVN53.26.26.C04.1.454.light.4.raw
agactatactcacgaccggtgctcgatttagtctagcgactttgggtttgggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccacggccaacctccgaggcgcctaatttataagatttctaatcgggattccggggtcccagacagattcagcggcagtgggtcaggcactgatttcacgctgaagatcagcaagggtggaggctgaggatgttgcggtttattactgcctgcagagttatcactggccgtggacgttcggccgaaggaccaaggtggaaatcaaacgaactgtggctgcac

SEQ ID NO: 785016 - DNA, 493 bp, Homo sapiens
  misc_feature: HIJSMM301BUE6W.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcggggcccagactatggatgaggctgactattactgtcaggcgtgggacagcaattctgtgattttcggcggaggacgagtgaccgtcctaggtcagccaaggctgccccctcggtcactctccg

SEQ ID NO: 785017 - DNA, 513 bp, Homo sapiens
  misc_feature: HIJSMM301EXH71.21.87.H10.1.454.light.4.raw
tcgtcgctcgcacgaccggtgctcgatttagcagtactgcgttgggtttgggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaaagccccaaaaactcttaatttctggcgtcaatcagcgaccctcacatgtttccagtcgattctctgcatccaagtctggcaacacggcctttctgacaatctctcaactccaggctgaagacgaggctatttattactgctcctcataacgcaggtggctactatttttcttgggtttttggcggcgggacccagatgactgtcctcagtcagccaaggctcgcccctcggt

SEQ ID NO: 785018 - DNA, 505 bp, Homo sapiens
  misc_feature: HIJSMM301EXMY1.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgccagctcatatacaaggagcaccactctcgtggtatttggtggaggaccagctgaccgtctaggtcagcccaaggctcgccccctcggt

SEQ ID NO: 785019 - DNA, 455 bp, Homo sapiens
  misc_feature: HIJSMM301BRGYO.40.76.G10.1.454.light.4.raw
tctagcgactcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaaagtatgacactgtccgctcactttcggcggagggaccaggtggaga

SEQ ID NO: 785020 - DNA, 530 bp, Homo sapiens
  misc_feature: HIJSMM301A3KIG.15.66.F11.1.454.light.4.raw
tctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactccggcctccctgaccgtctctgggctccaacctgaagatgaggctgattatttctgcggctcatatggagacaattacagtctttgtcttcggaaggtcgggaaccaaggtccaccgtcctaagtcacgacccaaggacccaaccccactcgtcctacctcctcgttccccaccctccctccg

SEQ ID NO: 785021 - DNA, 501 bp, Homo sapiens
  misc_feature: HIJSMM301AET3B.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccgaacgggacacgactggagaattaaaggaactggtggctgcaccactctgtcttctatccttccccg

SEQ ID NO: 785022 - DNA, 468 bp, Homo sapiens
  misc_feature: HIJSMM301ATXSX.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaacgggacacggactggagattaaacgaa

SEQ ID NO: 785023 - DNA, 493 bp, Homo sapiens
  misc_feature: HIJSMM301DE7DN.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccagggccagggcccctgtattggtcatctatgaggacaccaagcgaccctcggaatccctgagagagtcgctggctccaggtcagggacaatggcaccttgactatcactgggacccagatggacgatgaaggtgactaccactgtattcgacagacagcagtggtagtcgagggggtcttcgggcggagggacgaagctgaccgtcctgagtcacgccaagctcgccccctcggtc

SEQ ID NO: 785024 - DNA, 498 bp, Homo sapiens
  misc_feature: HIJSMM301A122Q.3.38.D05.1.454.light.4.raw
  modified_base (349)..(349): a, c, t, g, unknown or other
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtgatctggganagatttcactctcaccatcaacagtctgcaacctgaagtattttgctaacttacttactgtcaaacagtagtttacacctacccctctctacgtttcggacgggggtaccgaacggtggagatacaaacgaactagtggctgcacctac

SEQ ID NO: 785025 - DNA, 502 bp, Homo sapiens
  misc_feature: HIJSMM301E2PYN.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagttttattattgtcagacaattattatattccctcctcagacgttcgccgaagggaccaaggtggaaatcaaacgaacgtgtgggctgcacc

SEQ ID NO: 785026 - DNA, 497 bp, Homo sapiens
  misc_feature: HIJSMM301EJ6BJ.52.72.G06.1.454.light.4.raw
  modified_base (235)..(235): a, c, t, g, unknown or other
  modified_base (487)..(487): a, c, t, g, unknown or other
cgcagtacgacacgaccggtgctcgatttagctacgactgcaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgacaaggtcaccgtcctgggtcagcccaaggccaaccccnctcgtcactt

SEQ ID NO: 785027 - DNA, 493 bp, Homo sapiens
  misc_feature: HIJSMM301AFYV4.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactagaaaatcagcagagtggaggctgaggatggttggggtttattactgcatgcaagctctacaaactccttactacttttggccaggggaccaaggctggagatcaaacgaact

SEQ ID NO: 785028 - DNA, 464 bp, Homo sapiens
  misc_feature: HIJSMM301DDYVX.22.28.C06.1.454.light.4.raw
  modified_base (457)..(457): a, c, t, g, unknown or other
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtcccgaggatgaggctgattattactgtgcagcatgggattacaacctgagtgatcctagttgggtgttcgggcggagggaccaggctggaccgtcctaggtcagcccaaggctgccccctcggtcactctcgttcccaccctcctcacncgtatgt

SEQ ID NO: 785029 - DNA, 496 bp, Homo sapiens
  misc_feature: HIJSMM301BCV7A.10.32.C10.1.454.light.4.raw
catagtagtgcacgaccggtgctcgatttagtatagacatcaacacacaaagggggcaggagtcagtctcagtcaggacacagcatggacatgagggtccccgctcagctcctggggctcctgctactctggctccgaggtgccagatgtgacatccagatgacccagtctccaccgtccctgtctgcatttgtaggagacagagtcaccatctcttgccgggcaagtcagaacattgacacttatttaaattggtatcaacaaaaactggggaaagcccctacactcctgatcaatgctgcgtccagtttacagagtgggtcccatcaaggttcagtggcagtggatctgggacagactttactctcaccatcagcgatctgcagcctgacgattttgcgacttactactgtcaacagacgtttccggaaccccgtttacttcggcggagggaccgaaggtggagatcaaacgaactgtggctgcaccatctgtt

SEQ ID NO: 785030 - DNA, 458 bp, Homo sapiens
  misc_feature: HIJSMM301BD2XN.13.23.C01.1.454.light.4.raw
tcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggccctcagggatccctgaccgattctctgcctccaagtctggcacctcagcctccctggccatcagtcggctccagtctgaggatgaggctgattattactgtgcagcatactatgacaccctgaatggtctttgggtgttcggcggagggaccaagctgaccgtcctaggtcagcccaaggctgccccctcggtcactctgttcccgccctccctctagtacgtga

SEQ ID NO: 785031 - DNA, 512 bp, Homo sapiens
  misc_feature: HIJSMM301DBCJ5.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgcttgtgcttagttcggcggagggaccaagctgaccgtcttaagtcagcccaaggctgccccctcggcactctgttcccg

SEQ ID NO: 785032 - DNA, 504 bp, Homo sapiens
  misc_feature: HIJSMM301D5JDB.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgacccccagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctggtcactctcg

SEQ ID NO: 785033 - DNA, 527 bp, Homo sapiens
  misc_feature: HIJSMM301BWYR3.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcataatacaaccagtgacacttgggtgttcggcggagggaccaggctgaccgtcctaggtcagcccaaggctcgccccctcggtccactcctgttcccaccctt

SEQ ID NO: 785034 - DNA, 487 bp, Homo sapiens
  misc_feature: HIJSMM301EFE2F.13.39.D06.1.454.light.4.raw
  modified_base (428)..(428): a, c, t, g, unknown or other
tcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggttataactatgtctcctggtatcaacaacaccccaggcaaagcccccaaactcatcatttatgaagtcatttatcggccctcagggatttctaatcgcttctctggctccaagtctggcaacaccggcctccctgaccatctcgtggctccaggctgaagacgaggctgattattactgcganctcatataacaaccatacaacacacaggtcttcggaaggtggaccaagtacaccgtcct

SEQ ID NO: 785035 - DNA, 497 bp, Homo sapiens
  misc_feature: HIJSMM301BHW7S.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactgcctcggctcactttcggcgggtagggaccgaaggtggagagtcaaacgaactagtggcgtgcaccactctgtt

SEQ ID NO: 785036 - DNA, 510 bp, Homo sapiens
  misc_feature: HIJSMM301AH0UT.22.21.B10.1.454.light.4.raw
acatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctcgccccctcggtccactcttccg

SEQ ID NO: 785037 - DNA, 455 bp, Homo sapiens; identical to SEQ ID NO: 619360
  misc_feature: HIJSMM301ALWC0.19.86.H09.1.454.light.4.raw

SEQ ID NO: 785038 - DNA, 504 bp, Homo sapiens
  misc_feature: HIJSMM301D7DDJ.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaacgcccccaaactcctcatttatgaggtcactaagcggcccttaggggtccctgatcgcttctctggctccaagtctggcagaacggcctccctgaccgttctctgggctccaagctcgaggatgaggctgattattactgcagctcatatgcaggcagcagcatgtacttttggcggagggacccagactgacgtcctgggtcagccaaggctgccccctcggtcta

SEQ ID NO: 785039 - DNA, 516 bp, Homo sapiens
  misc_feature: HIJSMM301AKKC9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctctaaactgctcattaactgggcatctacccggcaatccggggtccctgaccgattcagtggcagcgggtctgggacagatttcactctcaccatcagcagcctgcaggctgaagatgtggctagtttattactgtctaaccagttttctcggggcgttcggccgaagggaccaaggtaggaaatacgaaaacgaacgtgtaggcgtcgcaccatctgtcttcactctttccccg

SEQ ID NO: 785040 - DNA, 502 bp, Homo sapiens
  misc_feature: HIJSMM301DW52Y.48.73.G07.1.454.light.4.raw
agtatacatacacgaccggtgctcgatttagctctacgctcagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacagacttcactctcaccgtcagcagactggaccctgagattttgcagtgtattactgtcagcagtatggtagctcaccgatccaccttcggccaagggacacgactggagtattaaccgaactcgtggctgcaccatctgtcttcatccttccccg

SEQ ID NO: 785041 - DNA, 510 bp, Homo sapiens
  misc_feature: HIJSMM301DTBGS.8.19.B08.1.454.light.4.raw
  modified_base (458)..(458): a, c, t, g, unknown or other
  modified_base (479)..(479): a, c, t, g, unknown or other
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccaccagttagcctggtaccaacacaaacctggccaggctcccaggcccctcatctttgatgcatccatcagggccactggcatccccagccaggttcagtggcagtgggtctgggacagacttcactctcaccatcagcagcctagagcctgaagattttgcagtttattactgtcaacatcgtaccgagtggcctccgggggccactttcggccctgggaccaaacttnagatcaaacgaactcgtggcngcaccatctgtcttcactcttcccgccactc

SEQ ID NO: 785042 - DNA, 492 bp, Homo sapiens
  misc_feature: HIJSMM301EQCKF.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttctactttggcctacggggaaccaaaccgtggatatcagaacgaacgtgtgg

SEQ ID NO: 785043 - DNA, 524 bp, Homo sapiens
  misc_feature: HIJSMM301CO6DM.51.53.E09.1.454.light.4.raw
cgatcgtatacacgaccggtgctcgatttagagagagtgtgttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacgttgggtgttcggcggcgggaccaaactcgaccgtcctacgtcacgcccaaggctcgcccctcggtcactctcgttccccg

SEQ ID NO: 785044 - DNA, 497 bp, Homo sapiens
  misc_feature: HIJSMM301BTBFE.52.54.E10.1.454.light.4.raw
cgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggcccccagggatccctgagcgattctctggctccaggtcagggacaacggtcacattggccatcagtggagtccaggcagaggacgaggctgactattattgtcaatcaacagacaccattgtacttatgtcttcggaactgcgacaaggtcaccgtcctggtcagcccaaggccaaccccactcgtctacc

SEQ ID NO: 785045 - DNA, 491 bp, Homo sapiens
  misc_feature: HIJSMM301BJUCC.13.87.H10.1.454.light.4.raw
  modified_base (235)..(235): a, c, t, g, unknown or other
  modified_base (431)..(431): a, c, t, g, unknown or other
tcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacngttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagtattttgcaacttattactgttcaacagcttaatagttacccnctcagtttcggcggaggaccgaaggtggagatcaaacgaactgtgctgccaccatctgtt

SEQ ID NO: 785046 - DNA, 477 bp, Homo sapiens
  misc_feature: HIJSMM301B7SZD.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacaactgagaggccctcagggatccctgagcgattctctggctccagctcagggacaacactcaccttgaccatcagtgcagtccaggcagaagacgaggctgactattattgtcaatcagcagtcagcactaattcttatcgggtgttggcggagggccaagctgcgtcctaggtcagcccaggctcgcccctcg

SEQ ID NO: 785047 - DNA, 519 bp, Homo sapiens
  misc_feature: HIJSMM301CTP56.41.55.E11.1.454.light.4.raw
tctatactatcacgaccggtgctcgatttagcactcgcacgttgggtttggggctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgagggccggggatgaggccacctactattgtcacgtctgggagactggtgatgatcctgtggcgctattcggcggagggacgaagctgaccgtcctgggtcagcccaaggctgccccctggtcactctgttccccgccctt

SEQ ID NO: 785048 - DNA, 509 bp, Homo sapiens
  misc_feature: HIJSMM301EIUSO.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggtcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccataacgtcttcggactgggaccaaggtctccgtctacgtcagcccaaggccaacccactcgtcactctccg

SEQ ID NO: 785049 - DNA, 494 bp, Homo sapiens
  misc_feature: HIJSMM301AQW4K.49.42.D09.1.454.light.4.raw
agtcgagagacacgaccggtgctcgatttagacacatacgcagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgctagtttattactgtcagcagcgtagcaactggcctctcacgtttcggcggagggaccaaggtggagatacaaacgaactggtggctgcaccatctgtt

SEQ ID NO: 785050 - DNA, 495 bp, Homo sapiens
  misc_feature: HIJSMM301AU7XS.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtcctgaccgattcagtggcagcgggtctgggacagatttcactctcaccatcagcagcctgcaggttgaagatgtggcagtttattactgtcagcagtattatactactcctctgacttcggccaagggaccaaggtggagatacaaacgaactgtggctgcctaccat

SEQ ID NO: 785051 - DNA, 503 bp, Homo sapiens
  misc_feature: HIJSMM301D26VM.48.38.D05.1.454.light.4.raw
agtatacatacacgaccggtgctcgatttagtatctgatagttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcgaggggtccctgatcgcttctctggctccaagtctggcaacacggcctcctgaccgtctctgggctccaggctgaggatggaggctgattattactgcagctcatatgcaggcagacaacaatggtggtattcgggacggagggaccaagctcgaccgtcctaggtcagcccaaggcctcg

SEQ ID NO: 785052 - DNA, 494 bp, Homo sapiens
  misc_feature: HIJSMM301A8HKD.13.5.A05.1.454.light.4.raw
  modified_base (426)..(426): a, c, t, g, unknown or other
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgccgattcagtggcagcgggtctgggacagatttcactcttcaccatcagcagcctgcaggctgaagatgtggcagtttattactgtcagcaatnttaatgtactcctccgaggctcactttcggtcggagggaccaaggtcggaggatacaaacgaaactgt

SEQ ID NO: 785053 - DNA, 507 bp, Homo sapiens
  misc_feature: HIJSMM301C4D37.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgttcttacggaactcgggaccaaggtctccgtcctacgtcagcccaaggccactccactgcactcc

SEQ ID NO: 785054 - DNA, 496 bp, Homo sapiens
  misc_feature: HIJSMM301EYCZO.16.78.H01.1.454.light.4.raw
  modified_base (473)..(473): a, c, t, g, unknown or other
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcacttctcaccatcagcagcctgcagtctgaagattttgcggtttattactgtcagcagtataataactggcctccaacggtactacgttttggtcgaggggaccaaggctgganatcaaacgactgtggctgcacca

SEQ ID NO: 785055 - DNA, 490 bp, Homo sapiens
  misc_feature: HIJSMM301EEGY3.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtgggtcccatcaagattcagtggcagtggatcgtgggacagatttcactctcgccatcagtagtctgcaacctgatgtattttgactaacttactactgtacaacagagttccactaccccaatcactttcggcccgtaggtactagagtgctatagtagaagaagaagtggtcgcgtcgcta

SEQ ID NO: 785056 - DNA, 511 bp, Homo sapiens
  misc_feature: HIJSMM301BD4NM.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatggaggccgactattactgtcaggtgtgggatagtagtggtgatcatccatacgtcttcggaactgggaccaaggtctccgtctacgtcagcccaaggccaaccccactgtcactctgttccccta

SEQ ID NO: 785057 - DNA, 327 bp, Homo sapiens
  misc_feature: HIJSMM301DNESP.9.25.C03.1.454.light.4.raw
tgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtacagcagaagccaggccaggcccctgtcctggtcgtctttgatagatagtgaccggccctcgagggat

SEQ ID NO: 785058 - DNA, 520 bp, Homo sapiens
  misc_feature: HIJSMM301C6XM6.5.59.F04.1.454.light.4.raw
atcagacacgcacgaccggtgctcgatttagtacacacacttagggattgggggagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcgaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgtcgcgtacggacgaagaggaagtagaacgaaacgtacgtaggtacgtgcgaccaactctcgttcttcttactacttccgtccctacc

SEQ ID NO: 785059 - DNA, 483 bp, Homo sapiens
  misc_feature: HIJSMM301CN7H1.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgtgggctctattattgcatgcagctctacaacgtccgctcactttcggcggagggaccaaggtggagatacaaacgaa

SEQ ID NO: 785060 - DNA, 506 bp, Homo sapiens
  misc_feature: HIJSMM301C5LZ4.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttacgggcttgggaccaagatcaccgtcctaggtcagcccaaggcccaaccccactcgtca

SEQ ID NO: 785061 - DNA, 494 bp, Homo sapiens
  misc_feature: HIJSMM301CA7PZ.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccaattggtacttatgtcttcgaactgcgaccaaggtcaccgtccgtggtcagccaaggccaacccactgtcactctccg

SEQ ID NO: 785062 - DNA, 519 bp, Homo sapiens
  misc_feature: HIJSMM301AGXDA.9.53.E09.1.454.light.4.raw
tgatacgtctcacgaccggtgctcgatttagagagagtgtgttgggtttgggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactccccgtggtattcgggacggagggaccgaacggtgaccggtcctagggtccaggcccaaacgggcctgtcccccccg

SEQ ID NO: 785063 - DNA, 489 bp, Homo sapiens
  misc_feature: HIJSMM301BSE28.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggactccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagccaaggctcgtcccccg

SEQ ID NO: 785064 - DNA, 464 bp, Homo sapiens
  misc_feature: HIJSMM301DR9FM.8.42.D09.1.454.light.4.raw
ctcgcgtgtccacgaccggtgctcgatttagacacatacgcagggaaagggggggggtctcaggaggcagcgctctcaggacgtcaccaccatggcctgggctctgctcctctcaccctctcactcagggcacagggtcctgggcccagtctgccctgactcagcctccctccgcgtccgggtctccgtggacagtcagtcaccatctcctgcactggagccagcagtgattacaactattactctcctggtaccaacaacacccaggcaaacgaccccaaactcatgatttttgaggtacaataagcggccctcacggggttccctgatcgtcttctcaggtctccaagtctgggaccaacgaccggtacctcccgtcgtaccgtcgtctgggctccaggactggagatgaggctgtattattactgcagctcatattcgaggctaccgagaacctaggggta

SEQ ID NO: 785065 - DNA, 503 bp, Homo sapiens
  misc_feature: HIJSMM301CO33M.18.11.A11.1.454.light.4.raw
  modified_base (481)..(481): a, c, t, g, unknown or other
  modified_base (496)..(496): a, c, t, g, unknown or other
  modified_base (501)..(501): a, c, t, g, unknown or other
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtcgtgggacagatttcactctcaccatcaccaacctgcaggctgaagatgtggcagttattactgtcagcaatactatacgtctcctctcacgttcggcggaggacacggtaggagatacaaacgaacngtggctgctacatcncgttntt

SEQ ID NO: 785066 - DNA, 497 bp, Homo sapiens
  misc_feature: HIJSMM301AWDIW.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgaccctcctgatctatgctgcatccagtttgcacagtggggtcccgtcaaggttcagtggcagtggatctgggacagatttcactctcaccgtcagcagtctgcaacctgaagtattttgcaactttactactgtcaacagagttaacacgtacccccctcacgtttcggcggagggaccaagggccggagatcagacgaactgtggctgcaccatctgtcttcta

SEQ ID NO: 785067 - DNA, 480 bp, Homo sapiens; identical to SEQ ID NO: 557442
  misc_feature: HIJSMM301DDBU4.8.53.E09.1.454.light.4.raw

SEQ ID NO: 785068 - DNA, 499 bp, Homo sapiens
  misc_feature: HIJSMM301A4A7H.5.48.E04.1.454.light.4.raw
atcagacacgcacgaccggtgctcgatttagagagcgtcacagagagaagggggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagtactttgtgctgtatttctgtcagcagtatgttttcgctacctttctactttcggcggaggaccgaaggtggagagcagacgaactgtggctgcaccatcttcg

SEQ ID NO: 785069 - DNA, 524 bp, Homo sapiens
  misc_feature: HIJSMM301DPFYA.41.30.C08.1.454.light.4.raw
tctatactatcacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcacgtggagtcttcggaactgggaccaggggtccaccgtcctaggtcacggcccaagggcccaacccccactcgtcacttccg

SEQ ID NO: 785070 - DNA, 521 bp, Homo sapiens
  misc_feature: HIJSMM301DHBIC.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccaggggagcccatgctgcaagtcgggccagaggtgcccctgaacctgaaggccaatgagacccaagacaggccaagtgggtgtgagacccctgaggagctgggccctggtcccaggcagcgctggccctgctgctgctgggtctggccatggtcgcccatggcctgctgcgccaatggttgcaccgcaaagcggggacccagaccctggagcctcagttggaagcagccgatccagcctgcggagccgtgtggggcaggtcagcccaaggcccaaccccactcgtcactcttccg

SEQ ID NO: 785071 - DNA, 416 bp, Homo sapiens
  misc_feature: HIJSMM301ALPZ6.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgccctctcgagtacgtaca

SEQ ID NO: 785072 - DNA, 512 bp, Homo sapiens
  misc_feature: HIJSMM301CMWM9.43.38.D05.1.454.light.4.raw
tgtgagtagtcacgaccggtgctcgatttagtatctgatagttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggccaaagcccccaaactcatgatttatgagggcactaagcggccctcaggggtttctgatcgcttctctggctccaagtctggcaacacggcctccctgacaatctctgggctccgaggctggaggacgaggctgattattattgctgctcatatgacaggtattacactttatgtcgttcggaagttgggacgacggtcaccgtcctagggtcacgcccaaggcccaaccccacg

SEQ ID NO: 785073 - DNA, 510 bp, Homo sapiens
  misc_feature: HIJSMM301AWYDA.48.26.C04.1.454.light.4.raw
agtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaacgcccccaaagtcatgatttatgaggtcagtaagcggccctcaggggtccctgatcgcttctctggctccaagtctggcaacacggcctccctgaccgtctctgggctccaggctgaggatgaggctgatttattactgcagctcatatgcaggcagcaacaatgtggtattcggcggagggaccaagctgaccgtcctaggtcacgcccaagggctcgtccccccg

SEQ ID NO: 785074 - DNA, 500 bp, Homo sapiens
  misc_feature: HIJSMM301EMYT3.43.77.G11.1.454.light.4.raw
tgtgagtagtcacgaccggtgctcgatttagctagtcactcaagggaaagggggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcagcccccaaactcctcatctatggtaccaccaatcggccctcaggagtccctgaccgattctctggctccaagtctggcatctcagccttcctggccatcactggactccaggtcgaggatgaggctgattattactgccaggcctgggacatcagcctgagtggccattatgtcttcggaaccgcgaccaaggtcaccgtcctaggtcagcccaaggcccaaccc

SEQ ID NO: 785075 - DNA, 513 bp, Homo sapiens
  misc_feature: HIJSMM301DKXPP.22.14.B03.1.454.light.4.raw
  modified_base (447)..(447): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagccctgccaggctgaagatgtggcagtttatattgtcagcaatatttatattcctccctnacgtacgttcggccaaagggtacccgaaggtgggaaaatcaaaacgtaactgtggcttgcacctac

SEQ ID NO: 785076 - DNA, 507 bp, Homo sapiens
  misc_feature: HIJSMM301A7GCA.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtgcagtttatactgtcagcaattattttcttatcctccgtggacgttcggccgaagggaccgacgggtggaaatcaagacgaactgtggactgcaccat

SEQ ID NO: 785077 - DNA, 515 bp, Homo sapiens
  misc_feature: HIJSMM301DSKQA.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagcccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagccctgcagcctgaagatgtggcaacttattaactgtcaacaatttcgttatactccgccgacgttcggccggggaccgaccgtcggaaatacaaacgaactagtgcgtgcaccatctgtctta

SEQ ID NO: 785078 - DNA, 525 bp, Homo sapiens
  misc_feature: HIJSMM301B901Y.48.81.H04.1.454.light.4.raw
agtatacatacacgaccggtgctcgatttagtagtgtagattcgcgggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaaagtaaaaatggaaacatttacttacattggtttcaacagaggccaggccagtctccaaggcgcctgatttatgtacgtttttaaacgggagtctggggtcccagacagattcagcggcagtgggtcagacactgacttcacactgagaatcagcgagggttgagggctggaggatgttggcacttattactgcatgcaaggctcacactggcctccgtggacgttcggccgaacgggacccgggtaggaaagtaaaacgaacgtgtggcgtgcacatctgtcttcatcttccccg

SEQ ID NO: 785079 - DNA, 387 bp, Homo sapiens
  misc_feature: HIJSMM301DEULE.41.28.C06.1.454.light.4.raw
  modified_base (343)..(343): a, c, t, g, unknown or other
  modified_base (372)..(372): a, c, t, g, unknown or other
tctatactatcacgaccggtgctcgatttagagctcacgtattggggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcaccttctaactttcggcggagggaccaaggtggagatacaaacgaactgtggntgcaccatctgtcttcatccttcccgccntctgaatagtataga

SEQ ID NO: 785080 - DNA, 512 bp, Homo sapiens
  misc_feature: HIJSMM301CPC7I.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgctattcggcggagggaccaaggctgaccgttccttaagtccagcccaaggctcgccccctcggtcactctcgtacccc

SEQ ID NO: 785081 - DNA, 497 bp, Homo sapiens
  misc_feature: HIJSMM301DJ4R2.48.44.D11.1.454.light.4.raw
agtatacatacacgaccggtgctcgatttagcgcagtacgaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgtaggatgtggctagtttattactgtcagcaatattatactactcgtggacttcggtccaacgggaccaaggtggaaatcagacgaactgtaggctgcaccat

SEQ ID NO: 785082 - DNA, 485 bp, Homo sapiens
  misc_feature: HIJSMM301DE5LK.26.37.D04.1.454.light.4.raw
agactatactcacgaccggtgctcgatttagtagcatactgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggccccctatacttttggcctagggaccaagctggagatcacaggaactgtggctgcacc

SEQ ID NO: 785083 - DNA, 501 bp, Homo sapiens
  misc_feature: HIJSMM301B63RK.43.37.D04.1.454.light.4.raw
tgtgagtagtcacgaccggtgctcgatttagtagcatactgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagtatttttcttctcgtcatcactggtctacagtctgacgacggcgcaatgtacttctgtcaacactatcgcctcctcccccctactaactttcggtcgaggggaccaagttagaacatcaatcgaactgtggctggcacctac

SEQ ID NO: 785084 - DNA, 513 bp, Homo sapiens
  misc_feature: HIJSMM301AERXN.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagttttatttcttgttcagcagtctgaagactggccgttcacgtttcggcggagggaccgaaggtcggacctcaaacgaactgtggctgcaccatctgtcttcactcttcccgcc

SEQ ID NO: 785085 - DNA, 522 bp, Homo sapiens
  misc_feature: HIJSMM301D1VQV.17.33.C11.1.454.light.4.raw
cgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggaggaccaagctgaaccgtcttaagtcagcccaaggcctgccccctcggtctactctcgttcccaccctccttcccg

SEQ ID NO: 785086 - DNA, 496 bp, Homo sapiens; identical to SEQ ID NO: 681271
  misc_feature: HIJSMM301DH62E.49.78.H01.1.454.light.4.raw

SEQ ID NO: 785087 - DNA, 493 bp, Homo sapiens
  misc_feature: HIJSMM301BZOYP.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctggtaccaacagaccccaggccagcctccacgcacgctcatctatagcacaaacactcgctcttctggggtccctgatcgcttctctggctccatccttggaaacaagctgcctcaccatcacggggcccaggcagatgatgaatctgtttattattgtgtcctatatatgggtgctggcatttcggtcttcggcggagggaccaagctgaccgtcctaggtcagcccaaggctcgccccctcggtcacctctcgttcccgccctcctcgctacgtaga

SEQ ID NO: 785088 - DNA, 498 bp, Homo sapiens
  misc_feature: HIJSMM301ATE02.40.50.E06.1.454.light.4.raw
tctagcgactcacgaccggtgctcgatttagatctactgacaacacacaagggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggagacaccggtgatattgggacttataaccttgtctcttggtaccaacagcacccaggcaaagcccccaaacttatgatttatgagggcagccagcggccctcatggatttctagtcgcttctctgcctccaagtctggcaacacggcctccctgacaatctctggactccaggctgaggacgaggctgagtattactgctgcgcatttgcaggtagtagcgtccccttatgtcttcgggactgggaccaaggtcacagtcctaggtcagaccccg

SEQ ID NO: 785089 - DNA, 516 bp, Homo sapiens
  misc_feature: HIJSMM301DUITQ.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtacaaaacaacaaacactcctggacccctgcccgattctcaggctccctccttgggggcaaagctgccctgacactgtctggtgtgcagcctgaggacgaggctgactattactgcctactctactttggtggtgctgtgctattcggcggtagggaccaagctagaccgtcttaagtcagcccaaggctcgccccctcggtccactctcgttcccta

SEQ ID NO: 785090 - DNA, 506 bp, Homo sapiens
  misc_feature: HIJSMM301ARCND.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgacttattattgcaatcagcagacaacagtaattacttattctttatgttcgttcggattcgtgggacctagggtccaccgtccttaggtcacgccccaaaggccctaaacccccg

SEQ ID NO: 785091 - DNA, 508 bp, Homo sapiens
  misc_feature: HIJSMM301EC96N.4.39.D06.1.454.light.4.raw
  modified_base (268)..(268): a, c, t, g, unknown or other
agcactgtagcacgaccggtgctcgatttagtgacatctcgcagttctttgggggggggtctcaggaggcagcgctctcaggacgtcaccaccatggcctgggctatgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaanaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcgggaagggaccaaaactgaccgtcctaggtcagcccaaggcctgccccctcc

SEQ ID NO: 785092 - DNA, 516 bp, Homo sapiens
  misc_feature: HIJSMM301D2DEL.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggcctcagggatccctgagcgattctctggctccaagtctgggaacacggccaccctgaccatcagcagggtcaagccggggatgaggccgatattactgtcaggtgtggaatggtgattatgattatgtcttcggaactgggaccaaggtcaccgtcctaggtcagcccaaggccaaccccactgtcactctcgtcccaccctcctccgtgt

SEQ ID NO: 785093 - DNA, 485 bp, Homo sapiens
  misc_feature: HIJSMM301BCXOU.10.59.F04.1.454.light.4.raw
catagtagtgcacgaccggtgctcgatttagtacacacacttaggggattgggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaattcatgatttatgatgtcagtgcgcggcccgtcgggggtccctgatcgcttctctggctccaagtctggcaacacggcctccctgaccatctctggcctccagcctgaggatgaggctgattattactgttgctcatatgcaggcggtaccgcttgggtgttcggcggtagggaccaagctgaccgtcctaggtc

SEQ ID NO: 785094 - DNA, 500 bp, Homo sapiens
  misc_feature: HIJSMM301DAV0F.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtcccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccagggcagagggacgaggctgactattattgtcaatcagcagacaacaagtaatacttattctttatgtcttcggatctgggaccagggtccaaccggtcctaggtcagcccaacggccaacccccgactcg

SEQ ID NO: 785095 - DNA, 466 bp, Homo sapiens
  misc_feature: HIJSMM301CNA4E.40.85.H08.1.454.light.4.raw
tctagcgactcacgaccggtgctcgatttagtatcactcagtcgcgggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttgggctggtatcagcagaaccagggagagcccctaagctcctcatctatgctgcatccactttacaaagtggagtcccatcaaggttcagcggcagtggatctggcacagatttcactctcaccatcagcagcctgcagcctgaagattttgcaacttattattgtctactacgactacagttaccctcgacgttcgcacggacgaacggtaggaatacaacgaa

SEQ ID NO: 785096 - DNA, 503 bp, Homo sapiens
  misc_feature: HIJSMM301CY7OR.17.27.C05.1.454.light.4.raw
  modified_base (430)..(430): a, c, t, g, unknown or other
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaaactcccgggacagcagtnctgaccaggtggtattcggacggagggacccactgaaccgtctaggtcagcccaaggctgccccctcggtcta

SEQ ID NO: 785097 - DNA, 518 bp, Homo sapiens
  misc_feature: HIJSMM301D92DW.40.67.G01.1.454.light.4.raw
tctagcgactcacgaccggtgctcgatttagagtatacatattggggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactcggcccctcacggttcgggcgggacgggaccaagggtggactatacaaaacgactggtggctgccaccattctgtcttcatccttcccgct

SEQ ID NO: 785098 - DNA, 493 bp, Homo sapiens
  misc_feature: HIJSMM301DAPP3.10.2.A02.1.454.light.4.raw
  modified_base (428)..(428): a, c, t, g, unknown or other
  modified_base (486)..(486): a, c, t, g, unknown or other
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggtcaggttccgtggcagtgggtctgggacaggagttcactgtcaccatcagcagcctgcagtctgaagattttgcagtttattactgtcagcagtataaatgctggcccgngacgttcggccaagggccgaggtggaattacaacgaactgtcggctgcaccagttccngttctta

SEQ ID NO: 785099 - DNA, 508 bp, Homo sapiens
  misc_feature: HIJSMM301BDL0R.47.85.H08.1.454.light.4.raw
  modified_base (402)..(402): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggcngattacttctgttgctcttgggcaactactgtcgtttgggtgttcggtcggagggaccgaagttgaccgtcctaggtcagcccaaggctgccccctccggtcactc

SEQ ID NO: 785100 - DNA, 522 bp, Homo sapiens; identical to SEQ ID NO: 543352
  misc_feature: HIJSMM301DVOQI.27.23.C01.1.454.light.4.raw

SEQ ID NO: 785101 - DNA, 517 bp, Homo sapiens
  misc_feature: HIJSMM301ENAFV.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctagttcggcggagggccaagctgaccgtacttaagtcacgcccaaggcctcgccccctcggtcactctcgttccccgt

SEQ ID NO: 785102 - DNA, 527 bp, Homo sapiens
  misc_feature: HIJSMM301C8GXT.41.19.B08.1.454.light.4.raw
  modified_base (461)..(461): a, c, t, g, unknown or other
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccagggcggaggacgagggtgattatttctgcagctcatttacaaccagccacaccttgctcttcggaactgggaccncggtcatcgtcctaggtcagcccaaggcccaacccccactcgtcactctcgttccccaccctccta

SEQ ID NO: 785103 - DNA, 511 bp, Homo sapiens
  misc_feature: HIJSMM301D3VD8.51.27.C05.1.454.light.4.raw
  modified_base (358)..(358): a, c, t, g, unknown or other
  modified_base (362)..(362): a, c, t, g, unknown or other
cgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggnaacncggcctccctgaccatctctgggctccaggccgaggacgaggctgattattactgcacctcatatacaagcagcaacaattgggtgttcggcggagggaccaagctgaccgtcctaggtcagcccaaggctgccccctggtcactctcg

SEQ ID NO: 785104 - DNA, 520 bp, Homo sapiens
  misc_feature: HIJSMM301CJ25O.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggcccaccctcccaaactcctgtcgtacaggaatgacaaccggccctcaaacatttcagagagattttctacctccaggacacaaaatacagcctctctgaccattactggtctccagcctgacgacgaggctgactactactgctcagcctcgggacaccacgcctcgctgcttggtccttttcggcggagggaccaagctcgaccgtcctcgggtcacgcccgaaggctcgccccccgtcggtctaccg

SEQ ID NO: 785105 - DNA, 524 bp, Homo sapiens
  misc_feature: HIJSMM301DQBEM.14.78.H01.1.454.light.4.raw
cgtctagtaccacgaccggtgctcgatttagtgtgagtagtttggggtttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgccctccaagtctggccacacggcctccctgacaatctctgggctccagactgaggacgagggtgattattactgctgctcatacggagggactagaactttgctattcggcggagggaccaagttgaccgtcctaagtcagcccaaggctcgccccctccggtcactctcgttccccg

SEQ ID NO: 785106 - DNA, 508 bp, Homo sapiens
  misc_feature: HIJSMM301CG51X.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattatactgcagctcatatgcaggcagcagcacgtccccatgtgatcgttcgggcggggggaccaaggctgaccgtccgtaggtcagcccaaggtccg

SEQ ID NO: 785107 - DNA, 497 bp, Homo sapiens
  misc_feature: HIJSMM301BATAG.41.44.D11.1.454.light.4.raw
tctatactatcacgaccggtgctcgatttagcgcagtacgaagggggggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctaccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttacgggcggagggactgaacttatcgtctaggtcagcccaaggctgtccccccg

SEQ ID NO: 785108 - DNA, 509 bp, Homo sapiens
  misc_feature: HIJSMM301DRCTJ.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatacttattcggcggagggaccaagctgaccgtcctgcgtcacgcccaaggctcgccccctcggtccacttccg

SEQ ID NO: 785109 - DNA, 533 bp, Homo sapiens
  misc_feature: HIJSMM301AOZL2.48.24.C02.1.454.light.4.raw
agtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaaggccggggatgaggccgactattactgtcaggtggtgggataggtagtagtgatcatcctaattgggtggttcggcgggacgggaccaaggctcgaccgtcctaggtcagcccaaggcctcgccccctcggtcacgtctcgttcccgccctt

SEQ ID NO: 785110 - DNA, 473 bp, Homo sapiens
  misc_feature: HIJSMM301EFEXT.46.26.C04.1.454.light.4.raw
  modified_base (433)..(433): a, c, t, g, unknown or other
  modified_base (444)..(444): a, c, t, g, unknown or other
  modified_base (457)..(457): a, c, t, g, unknown or other
  modified_base (472)..(472): a, c, t, g, unknown or other
actagcagtacacgaccggtgctcgatttagtctagcgactttgggtttgggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctcggggtccctgacaggttcagtggcagtggatcaggcacagattttacactgaaaatcagcagagtggaggctgaggatgttgggctctattattgcatgcaagctntacagtcccgntcactttcggcgngggaccaaggtggana

SEQ ID NO: 785111 - DNA, 519 bp, Homo sapiens
  misc_feature: HIJSMM301EASNW.51.27.C05.1.454.light.4.raw
cgatcgtatacacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctcgcccctcggtcactctcgttccccg

SEQ ID NO: 785112 - DNA, 487 bp, Homo sapiens
  misc_feature: HIJSMM301CATF3.26.60.F05.1.454.light.4.raw
  modified_base (336)..(336): a, c, t, g, unknown or other
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccacagggccactggtttcccagccaggttcagtggcngtgcgtctgcgacagagttcactctcaccatcaacagcctgcagtctgaagattttgctagtttattacttgtcagctagtatcatgactgccgctcacccttcggccaagggacacgactggagattaaacgaactgtggctgcaccgat

SEQ ID NO: 785113 - DNA, 500 bp, Homo sapiens
  misc_feature: HIJSMM301BLIHZ.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttgttgatgtataaagacactgagaggccctcagggatccctgagcgattctctggctccaggtcagggacaacggtcacattggccatcagtggagtccaggcagaggacgaggctgactattattgtcaatcaacgagacaccattggtacttatgtcttcggaactgcgaccaaggtcaccgtcctgggtcagcccaaggccaaccccactgtcacttcc

SEQ ID NO: 785114 - DNA, 504 bp, Homo sapiens
  misc_feature: HIJSMM301DQI9Y.13.50.E06.1.454.light.4.raw
tcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctagaacaaaaaatatgctcggtggttccagcagaagccaggccaggccccagtactggtgatttataaagacattgagcggccctcagggatccctgagcgattctccggctctaattcagggaccacagtccaccttgaccatcaccggggcccagattgaggatgaggctgactattattgttactctgcggctgacaaccatctggttttcggcgggggtaccaggttcgaccgtcgtggtcagccaaggctcgccccctcggtcactctccg

SEQ ID NO: 785115 - DNA, 532 bp, Homo sapiens
  misc_feature: HIJSMM301ES9O4.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcataatcggccctcaggggtttctaatcgcttctctggctccaagtctggcaacacggcctccctgaccatctctgggctccaggctggaggacgaggctgattattactgccaagctcatatacaagccaacgacacaacctctcctaagtcgttacgtaccgtacgggtacgaaccggttacgaaccgtcctaccggtagtacgaccgaaccgaacggtaa

SEQ ID NO: 785116 - DNA, 507 bp, Homo sapiens
  misc_feature: HIJSMM301C3N34.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcacgcccaaggcctcgccccccgtcggtccactcctcgttccccaccctcctcgagtgcgtctct

SEQ ID NO: 785117 - DNA, 455 bp, Homo sapiens
  misc_feature: HIJSMM301EQR16.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgacgtcctaagtcagcccaaggctgccccctcggtcactctcgttcccaccctcctccacgtagagta

SEQ ID NO: 785118 - DNA, 477 bp, Homo sapiens
  misc_feature: HIJSMM301DDF7D.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcaactttcggccctggactgaagtgcatatgaagagaactagtggctgca

SEQ ID NO: 785119 - DNA, 509 bp, Homo sapiens
  misc_feature: HIJSMM301EP48Q.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacgagcctgaagattttgcgacttactattgtcaacagagttaccttctccccggacgtcgtccgacggaaccgaacggtaggaaagtacgaagacgaacgtacgtggtcgtggccaccgactaccttacgt

SEQ ID NO: 785120 - DNA, 515 bp, Homo sapiens
  misc_feature: HIJSMM301DH9D0.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgttattctggtatcagcaactcccaggaatggcccccaaactcctcatccagaggaataatcagcggccctcaggggtccctgaccgattctctggctccaagtctggcacctcagcctcccctgaccatcaggtggcgtccggtccgaggatgaggctgactattactgtgcatcacgggacgcaacatgggatgacaatctgagcgggtttgggtgttcgggcggaggggacccaaacgtcgaccgtcctaggtccagccccaac

SEQ ID NO: 785121 - DNA, 503 bp, Homo sapiens; identical to SEQ ID NO: 567446
  misc_feature: HIJSMM301CV1V2.2.35.D02.1.454.light.4.raw

SEQ ID NO: 785122 - DNA, 505 bp, Homo sapiens
  misc_feature: HIJSMM301DNX5Q.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggcctcaggggtccctgatcgcttctctggctccaagtctggcaacacggcctcctgaccgtctctgggctccaggctgaggatgaggctgattattactgcagctcatatggaggcagcgactaatttggtgttcgggcggagggaccaagctgaccgtcctaggtcagcccaaggctgccccctcggtcactctcg

SEQ ID NO: 785123 - DNA, 417 bp, Homo sapiens; identical to SEQ ID NO: 680285
  misc_feature: HIJSMM301AKW0F.16.46.E02.1.454.light.4.raw

SEQ ID NO: 785124 - DNA, 500 bp, Homo sapiens
  misc_feature: HIJSMM301AFWB2.22.27.C05.1.454.light.4.raw
  modified_base (480)..(480): a, c, t, g, unknown or other
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcaggcgggtctgggacaggatttcactctcaccatcagcagcctgcaggctgaagatgtggcagtttattactgtcagcaatattatattcctcctcagacgttcggccaagggaccaaggtaggaaatanaaacgaatgtggctgcacat

SEQ ID NO: 785125 - DNA, 524 bp, Homo sapiens
  misc_feature: HIJSMM301AQEQT.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaacgcccccaaactcatcatttttgaggtcactacgcgaccctcaggggtccctgatcgcttctctggctccaagtctggcaacacggcctccctgaccgtctctgggctccaggctgaggatggaggctgattattactgcagctcatatgcaggcagcagcacgtccccatgtgatcgttcgggccggggggaccgaagctcgacccgtccgtacggtcgacgcccgaacggctcgtccccccg

SEQ ID NO: 785126 - DNA, 497 bp, Homo sapiens
  misc_feature: HIJSMM301DI04P.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctcttattattgcatgcagacaacacactggccgtactacttttcggccgaggggaccaagctaggagataccaatcgaactgt

SEQ ID NO: 785127 - DNA, 449 bp, Homo sapiens
  misc_feature: HIJSMM301B8U4V.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagccctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccaccctcctccatactcgta

SEQ ID NO: 785128 - DNA, 517 bp, Homo sapiens
  misc_feature: HIJSMM301EX5E6.22.30.C08.1.454.light.4.raw
  modified_base (424)..(424): a, c, t, g, unknown or other
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacnctggcgtctggctgttcggcggaggaccaagctcgaccgtcctaggtcagcccaaggctgccccctggtcactctgttcccgccctcctcacg

SEQ ID NO: 785129 - DNA, 493 bp, Homo sapiens
  misc_feature: HIJSMM301AEU9S.49.60.F05.1.454.light.4.raw
agtcgagagacacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgctagtttattactgtcagcagcgtagcaactggcctctcactttcggcggaggaccaaggtggagatacaaacgaactgtggctgcaccatctgttctt

SEQ ID NO: 785130 - DNA, 506 bp, Homo sapiens
  misc_feature: HIJSMM301AP8OV.5.24.C02.1.454.light.4.raw
  modified_base (448)..(448): a, c, t, g, unknown or other
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgctctctggctccaagtctggcaacacggcctcctgaccgtctctgggctccaggctgaggatgaggctgattattactgcagctcatatgcaggcagcagcacgtccccatntgatcttcggcggggggaccaagctgaccgtcctaggtcagcccaaggctgccccccg

SEQ ID NO: 785131 - DNA, 508 bp, Homo sapiens
  misc_feature: HIJSMM301EFF2J.18.78.H01.1.454.light.4.raw
  modified_base (437)..(437): a, c, t, g, unknown or other
  modified_base (485)..(485): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcataatacaagcagnagcactcaagtcttcggaactgggaccaaggtcaccgtcctaggtcancccaagccaaccccactagtcta

SEQ ID NO: 785132 - DNA, 501 bp, Homo sapiens
  misc_feature: HIJSMM301EXB16.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactagaaaatacagcagagtggaggctgaggatgttgggggtttattactgcatgcaagctctacaaactaccttactacttttggtccgacggggaccaagctggagatacaaacgaactagt

SEQ ID NO: 785133 - DNA, 501 bp, Homo sapiens
  misc_feature: HIJSMM301AJVRX.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctcaggctgaggacgaggctgattattactgcagctcatatacaagcagcagcactcaagtcttacggaactgggaccaaggtcaccgtctaggtcagcccaaggcccaaccccga

SEQ ID NO: 785134 - DNA, 517 bp, Homo sapiens
  misc_feature: HIJSMM301ATYR4.9.43.D10.1.454.light.4.raw
tgatacgtctcacgaccggtgctcgatttagactagcagtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaacacggcctccctgaccgtctctgggctccaggctgaggatgaggctgatttattattgcagctcatattcaggcagtaacagggttttcggcggagggaccaagctgaccgtcctaggtcagcccaaggcctcgccccctcggtcactctcgttcccaccctcctctacg

SEQ ID NO: 785135 - DNA, 503 bp, Homo sapiens
  misc_feature: HIJSMM301EDF6L.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcaggggacgacagtcacgttgaccatcggtggagtccaggcagaagacgaggtgactatactgtcagtctgcaaacaccactgcaggcggtggttcggcggaggaccgaagctgaccgtcctgcgtcacgccaaggctcggccccctcggtccactcctcgttccccta

SEQ ID NO: 785136 - DNA, 522 bp, Homo sapiens
  misc_feature: HIJSMM301BWJAG.16.66.F11.1.454.light.4.raw
  modified_base (489)..(489): a, c, t, g, unknown or other
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtcgcccccaccagagtgatctatgaggataacctacggccctctggggtccctcctcggttttctggctccatcgacgggtcctccactactgcctccctcacccatctctggactgaagactgaggacgaggctgactactactgtcagtcttatgataacaccgagggtggtgttcggcggagggaccaagctggccgtcctaggtcagcccaaggctcgccccctcggtcnctccttgttccccgccctcctcgagtagtacca

SEQ ID NO: 785137 - DNA, 487 bp, Homo sapiens
  misc_feature: HIJSMM301AJZHE.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagtattttgactaacttactactgtcaacagtagtttcacctacccctctccactttcgggcgggggaccaaggtggagatcaaacgaactagtggctgca

SEQ ID NO: 785138 - DNA, 537 bp, Homo sapiens
  misc_feature: HIJSMM301EXRKH.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggccgacgggaccgaccgacggtaacgaaagtagaaggacgaaccgtagtaggtcgtagtcaccgaactcctgttcttctacttccttaccccgtcccc

SEQ ID NO: 785139 - DNA, 496 bp, Homo sapiens
  misc_feature: HIJSMM301EOAQK.41.16.B05.1.454.light.4.raw
tctatactatcacgaccggtgctcgatttagagctcacgtaaggggggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggcctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtacactttggccaggggaccaagctcgagatcaaacgaactagtggctgcaccatctgtcttcatcttcccgccta

SEQ ID NO: 785140 - DNA, 487 bp, Homo sapiens
  misc_feature: HIJSMM301BXYDW.26.60.F05.1.454.light.4.raw
  modified_base (403)..(403): a, c, t, g, unknown or other
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctaagtttnttactgtcagcagtatcatgactggccgctcaccgttcggccaagggacacgactggagattaaacgaactgtggctgcaccat

SEQ ID NO: 785141 - DNA, 524 bp, Homo sapiens
  misc_feature: HIJSMM301APIQZ.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccggctccagcctgaggacgaggctgattattattgtagttcatatacaaccagtgacacgttgggtgttcggcggagggacccaggctgaccgtcctaggtcagcccaaggctcgccccctcggtcactctgttccccgccct

SEQ ID NO: 785142 - DNA, 508 bp, Homo sapiens
  misc_feature: HIJSMM301DLFSQ.49.53.E09.1.454.light.4.raw
  modified_base (486)..(486): a, c, t, g, unknown or other
agtcgagagacacgaccggtgctcgatttagagagagtgtgttggggtttgggggtgggtccaggaggcagaactctgggtgtctcaccatggcctggatccctctacttctccccctcctcactctctgcacaggctctgaggcctcctctgaattgcaacagacatcctcggtgtcagcgtccccagggacagacggccagaatttacttgctctggagatgcattggcgaaacaatttgcttcttggttccagcagaagccaggccaagcccctatcttgatgatctataaaggctctgagaggccctcagggatccctgagcgattctctgggtcccactcagggggccacagccgtgttgaccatcactggagtccaggcagaagacgaggctgactattattgtcagtcagccgacaacactattgtctcgtgtttttcggcggagggaccaggctgaccgtcctgggtcagccaaggcncgcccctcggtccactcttccg

SEQ ID NO: 785143 - DNA, 517 bp, Homo sapiens
  misc_feature: HIJSMM301A1MV3.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaaggctgaccgtcttaagtcagcccaaggctggccccctacggtcactctgttcccgccctcct

SEQ ID NO: 785144 - DNA, 491 bp, Homo sapiens
  misc_feature: HIJSMM301EG6TQ.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaattatatagtactcctccgaggctctactttcggcggagggaccaaggtggagatacaaacg

SEQ ID NO: 785145 - DNA, 536 bp, Homo sapiens
  misc_feature: HIJSMM301EA1P5.53.77.G11.1.454.light.4.raw
cgcgtatacacacgaccggtgctcgatttagctagtcactcaagggaaagggggggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggcctcaggggtccctgagcgattctctggctccaactcgtgggaacacggccaccctgaccataagcagggtcgaagccggggatgaggccgactattactgtcaggtgtgggatactagtagtgatcatcctgggtgttcggcggtgggaccaggctgaccgtccgtaggtcgagtcccgaaggctcgccccctcggtccgactctcgttcccgccctcctctccgtactcg

SEQ ID NO: 785146 - DNA, 508 bp, Homo sapiens
  misc_feature: HIJSMM301DZ554.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagacccgggccagactccacgcacgctcatctacaacacagacactcgctcttctggggtccctgatcgcttctctggttccatccttgggaacaaagctgccctcaccatcgcggggcccaggcagatgatgagtgtgattattactgtgtgctctatatgggcagtggtcgtttgggtgttcggcggtagggaccaagctggaccgttcg

SEQ ID NO: 785147 - DNA, 493 bp, Homo sapiens
  misc_feature: HIJSMM301AGRQB.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagacggcctcagggatccctgagcgattctctggctccaggtcagggacaacggtcacattggccatcagtggagtccaggcagaggacgaggctgactattattgtcaatcaacagacaccattggtacttattgtcttcggaactgcgaccaggtcaccgtcctggtcagcccaagccaacccactgtcta

SEQ ID NO: 785148 - DNA, 457 bp, Homo sapiens
  misc_feature: HIJSMM301A9IR8.49.85.H08.1.454.light.4.raw
agtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctaatcaagataccaagcggccctcagggatccctgagcgattctctggctccaaactctgggaacacagccactctgaccatcagcgggactcaggctatcgatgaggctgactattactgtcaggcgtgggacagccgcactgggtattggcggagggaccaaagctgacgt

SEQ ID NO: 785149 - DNA, 498 bp, Homo sapiens
  misc_feature: HIJSMM301EBZ6Q.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctctaagtgatcaaccttcggccgaaggacaacgactggagattaaacgaactgtggctgcaccatctgtt

SEQ ID NO: 785150 - DNA, 488 bp, Homo sapiens
  misc_feature: HIJSMM301BI62K.16.81.H04.1.454.light.4.raw
tgtactactccacgaccggtgctcgatttagtagtgtagattcgcgggggaggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatggattttgcgacttattattgccaacagtataaagagttattcaactttcggcccgtagggacccaatgtggatatcaaacgaactgtggctgcaccatctgtt

SEQ ID NO: 785151 - DNA, 493 bp, Homo sapiens
  misc_feature: HIJSMM301CIELA.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctggaggatgttggctatttattactgtcatgcaggctatacaccttcctgcctacttttggccaggggaccaagcgtggagatcaggcgtaacg

SEQ ID NO: 785152 - DNA, 514 bp, Homo sapiens
  misc_feature: HIJSMM301EXMB4.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcactcagcctccctggccatccgtgggctccagtctgaggatgagtctgattattactgtgcaacatgggatgacagcctgaatggtccggtattcgggcggagggaccaagctgtaccgtcctccggtcacgcccaaggctcgtccccccg

SEQ ID NO: 785153 - DNA, 515 bp, Homo sapiens
  misc_feature: HIJSMM301EXZQZ.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgcttattcggcggagggaccaagctgaccgtcttaagtcagccaaggctgccccctcggtcactctcgttcccaccctcctcgctacg

SEQ ID NO: 785154 - DNA, 507 bp, Homo sapiens
  misc_feature: HIJSMM301BINUL.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgaattactactgctgctcatatgcaggtcgtatcttcttatgtcttcggaactgggaccaaggtcaccgtcctacggtcagcccaaggccaaccccactgtcta

SEQ ID NO: 785155 - DNA, 509 bp, Homo sapiens; identical to SEQ ID NO: 576693
  misc_feature: HIJSMM301A6AUX.5.24.C02.1.454.light.4.raw

SEQ ID NO: 785156 - DNA, 501 bp, Homo sapiens
  misc_feature: HIJSMM301A3TZH.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcaggtgggtctgggacagacttcactctcaccatcagcagactggagcctgaggtattttgcagtgtattactgtcagcagtatcatagggtacaaacaccttcggccaagggacacgactggaagaattaaaggaactgtggctgcaccatctgtcttctatcttccccg

SEQ ID NO: 785157 - DNA, 492 bp, Homo sapiens
  misc_feature: HIJSMM301DHBPT.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctcctggccatcactgggctccaggctgaggatgaggctgactattactgccagtcgtatgacagtggcctaagtaacatcgtcttcggaactgggaccaaggtcaccgtccg

SEQ ID NO: 785158 - DNA, 510 bp, Homo sapiens
  misc_feature: HIJSMM301BVZV4.21.22.B11.1.454.light.4.raw
  modified_base (470)..(470): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcacgcctccctgaccatcagtgggctccggtccgaggatgaggctgactattactgtgcatcacgggacgcaacatgggatgacaatctgagcgggttgggtggttcggnggacgggaccaaactcgaaccgtcctaggtcacgcccaac

SEQ ID NO: 785159 - DNA, 496 bp, Homo sapiens
  misc_feature: HIJSMM301AQK6Z.26.72.G06.1.454.light.4.raw
  modified_base (467)..(467): a, c, t, g, unknown or other
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtcggagaatcagacgaacngtggctgcaccatctgtcttcatcttccg

SEQ ID NO: 785160 - DNA, 506 bp, Homo sapiens
  misc_feature: HIJSMM301AO8K5.27.78.H01.1.454.light.4.raw
agcgtcgtctcacgaccggtgctcgatttagtgtgagtagtttgggtttgggggagtgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgacaacttattactgtcatcagtagtactactttacctcaagtgatctaccttcggccaagggaccacggactgggagtaattaaacgaactgtaggctgccaccatctgtctt

SEQ ID NO: 785161 - DNA, 529 bp, Homo sapiens
  misc_feature: HIJSMM301ECWT6.43.45.E01.1.454.light.4.raw
tgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagcccccctcggtgtctgtggccccaggacagacggccagcattacctgtgggggatacaactttgcccagaaaaatgtacattggtatcagcagaaggcaggccaggcccctgtgatggtcgtctgtgacgatagggaccggccctcggggatccttgagcgattctctggctccaagtctgggaacacggccactctgaccatcagccgggtcgaggccggggacgaggcgactattattgtcaactgtgggatggtactggtgaccggtactgggtggtttggcggagggaccaagctgaccgtcctaggtcagcccaaggctcgccccctcggtcactctgttcccaccctcctcactactca

SEQ ID NO: 785162 - DNA, 497 bp, Homo sapiens
  misc_feature: HIJSMM301DN4M3.9.75.G09.1.454.light.4.raw
tgatacgtctcacgaccggtgctcgatttagtatagacatcaggggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtggggtcccatcaagattcagcggcagtggatctgggacagaattcactctcaccatcagcagtctgcagcctgatgattttgctaattattactgccaacagtataattagttatccgtggacatttgggacaaggggaccgaggtggaagtcgaaacgaactgtggactgacaccatctgtcttcattcc

SEQ ID NO: 785163 - DNA, 518 bp, Homo sapiens
  misc_feature: HIJSMM301AU6K5.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcacttccg

SEQ ID NO: 785164 - DNA, 523 bp, Homo sapiens; identical to SEQ ID NO: 621621
  misc_feature: HIJSMM301B2DKT.27.23.C01.1.454.light.4.raw

SEQ ID NO: 785165 - DNA, 508 bp, Homo sapiens; identical to SEQ ID NO: 536521
  misc_feature: HIJSMM301AI7TU.17.33.C11.1.454.light.4.raw

SEQ ID NO: 785166 - DNA, 485 bp, Homo sapiens
  misc_feature: HIJSMM301BAJNB.51.60.F05.1.454.light.4.raw
cgatcgtatacacgaccggtgctcgatttagtacgtcatcagggaaagggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggataccgtgagcgattctctggctccacctctgggaacacagccactctgaccatcagcgggacgcaggctgtggatgaggctgacttttactgtcaggcgtggacgagcgacactgccggtcgttcggcggagggaccaagctgaccgtcctcggtcagcccaaggctccg

SEQ ID NO: 785167 - DNA, 498 bp, Homo sapiens
  misc_feature: HIJSMM301DPMWK.49.67.G01.1.454.light.4.raw
agtcgagagacacgaccggtgctcgatttagagtatacatattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagtattttgcagtctattactgtcagcagcgttacaactggcctcccatgtactactttggtccacggggaccaagctaggaaatcaagacgaaactgtggctgcaccat

SEQ ID NO: 785168 - DNA, 508 bp, Homo sapiens
  misc_feature: HIJSMM301AZB83.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggacgtgggaccaagatcaccgtcctaggtcagacccaaggcccaacccacctcgtcta

SEQ ID NO: 785169 - DNA, 492 bp, Homo sapiens
  misc_feature: HIJSMM301DVB4W.48.71.G05.1.454.light.4.raw
agtatacatacacgaccggtgctcgatttagtgtcgtcgcaagagagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatacaaacgaactgtggctgcaccatctgtcttcatcttcccgccatctgatatgtata

SEQ ID NO: 785170 - DNA, 504 bp, Homo sapiens
  misc_feature: HIJSMM301EUBG1.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcgcctcaggggtttctaatcgcttctctggctccaagtctggcaacacggcctccctgaccatctctgggctccaggctagatgacgatgctgatttattactgcaggtcatatacaatcagcaacacttatgtcttcgggactgggacaagatcaccgtacctaggtcagacccgaacggcccaacccactgta

SEQ ID NO: 785171 - DNA, 526 bp, Homo sapiens
  misc_feature: HIJSMM301AYT77.47.85.H08.1.454.light.4.raw
agctcacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgcgtcaatgttcgccccccaggggtttctcatcgcttctctggctccaaatctggcaacacggctccctgaccatctctgggctcgagtctgagggacgaggctgattacttctgtttgctcttgggcaactactgtcgtttgggtgttcggcgggaggaccgaagttgaccgtccttaggtcagcccaaggcctgccccctcggtccactctcgttccccgtccccg

SEQ ID NO: 785172 - DNA, 418 bp, Homo sapiens
  misc_feature: HIJSMM301ETJ2I.19.86.H09.1.454.light.4.raw
  modified_base (415)..(415): a, c, t, g, unknown or other
tactctcgtgcacgaccggtgctcgatttagtgctatagacttgggtttgggggccgttcctgggactttctgataccacatcacaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcgggcggagggaccaagctgaccgtcctaagtcagccaaggctgccccctcgctcactctgttcccgccctcctccacgagngta

SEQ ID NO: 785173 - DNA, 511 bp, Homo sapiens
  misc_feature: HIJSMM301AOXBM.17.28.C06.1.454.light.4.raw
  modified_base (444)..(444): a, c, t, g, unknown or other
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagccctccctgaccatcagtgggcctccggtcgaggatgaggctgattattactgtgcaccgtgggatgacatccngaatggtccggtgttcggcggaggaccaggcctgacccgtctaagtcagcccaaggctcgccccctc

SEQ ID NO: 785174 - DNA, 492 bp, Homo sapiens
  misc_feature: HIJSMM301AYDTK.41.64.F09.1.454.light.4.raw
tctatactatcacgaccggtgctcgatttagcgcgtatacaagggggaggttctttctctgggatgtggcatgagcaaaactgacaagtcaaggcaggaagatgttgccatcacaactcattgggtttctgctgctctgggttccagtctccaggggtgaaattgtgctgactcaatctccagactttcagtctgtgactccaaaggagaaagtcaccatcacctgccgggccagtcagagcattggttatagcttacactggtaccagcagaaaccagatcagcctccaaagctcctcatcaagtatgcttcccagtccatctcaggggtcccctcgaggttcagtggcagtggatctgggacagatttcaccctcaccatcaatagcctggaagctgaagatgttgcaacgtattactgtcatcagagtagtactttacctcggacctcggtccaaggacacgtacagtagaattaaacgaaactagtgg

SEQ ID NO: 785175 - DNA, 521 bp, Homo sapiens
  misc_feature: HIJSMM301A0XLC.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccgggtgatgaggctgactattttgtcaggtgtgggacagcagcatttatgtcttcggacctgggacaaggtccaccgtcctaggtcagcccaaggcccaaccccactcgtcactctcgttccccacctccctcgaccg

SEQ ID NO: 785176 - DNA, 504 bp, Homo sapiens
  misc_feature: HIJSMM301BO5LK.9.53.E09.1.454.light.4.raw
  modified_base (443)..(443): a, c, t, g, unknown or other
tgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccacagcacccaggcaaacgcccccaaactcatcatttatgaggtcactaagcggccctcgaggggtttctattcgcttctctggctccaagtctgacaacacggcctccctgacaatctctgggctccaggctgaggacgaggctgatttattactgctgctcatatgcagatggtanacactccgtggtattcggcggagggaccaaggtgaccgtcctaggtcacgcccaaggtccg

SEQ ID NO: 785177 - DNA, 498 bp, Homo sapiens
  misc_feature: HIJSMM301AG4IX.19.71.G05.1.454.light.4.raw
  modified_base (470)..(470): a, c, t, g, unknown or other
  modified_base (477)..(477): a, c, t, g, unknown or other
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactaacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggtacgtcggcacggacaacggnggatatnagacgaactacgtggtcgtcg

SEQ ID NO: 785178 - DNA, 513 bp, Homo sapiens
  misc_feature: HIJSMM301CHDNX.16.46.E02.1.454.light.4.raw
  modified_base (500)..(500): a, c, t, g, unknown or other
tgtactactccacgaccggtgctcgatttagactcatctacagggaaaggggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcacggggtccctgatcgcttctctgggtccaagtctggcaacacggcctccctgaccatctctgggctccaggctgaggcgaggctgattattactgcagcttatatacaggcaacaatacttttgtcttcggaactgggaccaaggtcaccgtcctaggtcagcccaaggccaaccccnctgtcactctccg

SEQ ID NO: 785179 - DNA, 529 bp, Homo sapiens
  misc_feature: HIJSMM301A0FDB.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctcgaccatctccgggctccagcctgaggacgaggctgattattatttgtagttcattatacaaccagtgacacttgggtgtttcgggcggagggaccaggctgaccgtcctaggtcagcccaaggctcgccccctcggtcactctcgttccctaccct

SEQ ID NO: 785180 - DNA, 513 bp, Homo sapiens
  misc_feature: HIJSMM301DEJHO.21.87.H10.1.454.light.4.raw
tcgtcgctcgcacgaccggtgctcgatttagcagtactgcgttgggtttgggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggctttctgacaatctctcaactccaggctgaagacgaggctatttattactgctcctcatacgcaggtggcactatttttcttggttttttggcggtcgggacccagatagactgtcctcacgtcagcccaaggctcgccccctcggt

SEQ ID NO: 785181 - DNA, 511 bp, Homo sapiens
  misc_feature: HIJSMM301ERJCX.48.53.E09.1.454.light.4.raw
  modified_base (450)..(450): a, c, t, g, unknown or other
agtatacatacacgaccggtgctcgatttagagagagtgtgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcgaggggtccctgatcgcttctctggctccaagtctggcaacacggcctaccctgaccgtctctgggctccaggctgaggatgagctgattattactgcagctcatatgcaggctagcaaacaatgnggttacttcggcgggagggacccaaagctaggaccgtcctaaggtcacgccaaggctcccg

SEQ ID NO: 785182 - DNA, 355 bp, Homo sapiens; identical to SEQ ID NO: 555628
  misc_feature: HIJSMM301C1O72.19.22.B11.1.454.light.4.raw

SEQ ID NO: 785183 - DNA, 502 bp, Homo sapiens
  misc_feature: HIJSMM301D2COF.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatcccactttggaaagtggggtcccctcaaggttcagcggcagtggatctgggacagatttcactctcgccatcagcagcctgcagactgaagtattttgctaactttatttttgtctaacaggctaacacctttcccccctctacctttcgggccggagggaccgaaggtggtaagatcaagcgaactgtggctgcaccat

SEQ ID NO: 785184 - DNA, 441 bp, Homo sapiens; identical to SEQ ID NO: 550529
  misc_feature: HIJSMM301CCTWO.41.9.A09.1.454.light.4.raw

SEQ ID NO: 785185 - DNA, 499 bp, Homo sapiens
  misc_feature: HIJSMM301AYDR3.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagacctgaagattttgctagtttattactgtcagcagcgtagcaactggcctctcactttcggcggaggaccgaaggtggagatacaaacgaactagtggctgcaccatctgtctt

SEQ ID NO: 785186 - DNA, 516 bp, Homo sapiens
  misc_feature: HIJSMM301BLLNM.48.53.E09.1.454.light.4.raw
agtatacatacacgaccggtgctcgatttagagagagtgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaaagaaaattttgttattggtaccaactgaagtcaggccaggcccctgtcctgggtcatttatgaggacgaccagcgaccctccaggatccctgcgaggttctctggatcgaactcagggacattggccaaccttgactatcactggggcccaggtggaggatggaaggtgactacttctgtttctcaacagacaccagtgacaatcatgcgattttcggcggagggaccaagctgaccgtcctgggtcacgaccaaggctcgccccctcggtcaccgtctcgtt

SEQ ID NO: 785187 - DNA, 511 bp, Homo sapiens
  misc_feature: HIJSMM301AH3OL.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctccccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggacccaaagtggaaatcaaacgaactgtggctgcaccatctgtcttcatcttcccgccat

SEQ ID NO: 785188 - DNA, 517 bp, Homo sapiens
  misc_feature: HIJSMM301BFO7S.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaacgcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcgggcggaagggaccaaggctgaccgtccgtggtcagcccgtaaggcctcgcccccgtcggtcctaccg

SEQ ID NO: 785189 - DNA, 491 bp, Homo sapiens
  misc_feature: HIJSMM301D9EHJ.15.1.A01.1.454.light.4.raw
  modified_base (482)..(482): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaatttattactgctgctcatatgaaggttataacactatactattcgggcggagggaccaagctgaccgtcctgcgtcacgccaacggctcgccccctccggtcactctcgttcccacccttctcnctacgtaga

SEQ ID NO: 785190 - DNA, 417 bp, Homo sapiens; identical to SEQ ID NO: 726908
  misc_feature: HIJSMM301DLFI0.16.46.E02.1.454.light.4.raw

SEQ ID NO: 785191 - DNA, 524 bp, Homo sapiens
  misc_feature: HIJSMM301EE7JG.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagttcagcccaaggctgccccctcggtccactctgttcccaccctt

SEQ ID NO: 785192 - DNA, 506 bp, Homo sapiens
  misc_feature: HIJSMM301BNEIM.48.26.C04.1.454.light.4.raw
agtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcgtccccccg

SEQ ID NO: 785193 - DNA, 502 bp, Homo sapiens
  misc_feature: HIJSMM301BX1JQ.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagccagaaaccaggacagcctcctaagctgctcatttactgggcatctactccgggaatccggggtccctgaccgattcagtggcagcgggtctgggacagatttcactctcaccatcagcagcctgcaggctgaagatgtggcagtttattactgtcagcaatattatagtactcctccgaggctcactttcgggcgtagggaccaaagggtggaggatacgaaacgaactgtggtcg

SEQ ID NO: 785194 - DNA, 499 bp, Homo sapiens
  misc_feature: HIJSMM301CS8HM.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacaggggccactggcatccccagacaggttcagtggcagtgggtctgggacagacttcactctcaccatcagcagactggagcctgaggattttgcagtgtattactgtcagcagtatcataggtacaaacaccttcggccaagggacacgacgtggagattaaaggaactgtggctgcaccatctgtcttcatcttaccccg

SEQ ID NO: 785195 - DNA, 510 bp, Homo sapiens
  misc_feature: HIJSMM301AZT91.10.27.C05.1.454.light.4.raw
catagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgccttctttcaaggttttcggcggagggaccgaggctgaccgtcctaagtcagcccaaggctcgccccctcggt

SEQ ID NO: 785196 - DNA, 517 bp, Homo sapiens
  misc_feature: HIJSMM301B4Y9L.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactcttactttggtggtgctgtgcttattcggcggagggaccaagctgaccgtcttaagtcagcccaaggctcgccccctcggtcactctcgttcccgccctcct

SEQ ID NO: 785197 - DNA, 533 bp, Homo sapiens
  misc_feature: HIJSMM301B7NOV.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtggggtctgggacagacttcactctcaccatcagcagcctagagcctgaagattttgcagtttattactgtcaacatctaccgagtggcctccgggggccactttcggccctcgggaccaaaattagtagatctaaacaaaccgtgttgggctcggcaacccaactctacgtctttccaacttcttccccgtcccattcc

SEQ ID NO: 785198 - DNA, 515 bp, Homo sapiens
  misc_feature: HIJSMM301B5FIA.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggttggttcggcggagggaccaagctgaccgtcctgcgtcagcccaaggctcgccccctcggtcactc

SEQ ID NO: 785199 - DNA, 467 bp, Homo sapiens
  misc_feature: HIJSMM301BNK0N.11.73.G07.1.454.light.4.raw
  modified_base (426)..(426): a, c, t, g, unknown or other
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctnaactttcggcccgtgggaccaggagtggacatagaaacgaa

SEQ ID NO: 785200 - DNA, 500 bp, Homo sapiens
  misc_feature: HIJSMM301BRKB0.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtacaacagacttacagtcgcccccccgatccaccttcggccaagggaccacggacctggacgaagttaaaacgaactgtggctgccaccatctcgtcttc

SEQ ID NO: 785201 - DNA, 511 bp, Homo sapiens
  misc_feature: HIJSMM301BSHS5.5.86.H09.1.454.light.4.raw
atcagacacgcacgaccggtgctcgatttagtgctatagacttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactagttactgcagctcatttgcaggcagccgtatactcttcggcggaggaccaagctcgaccgtcctaggtcacgcccaaggcctcgcccccgtcgtccgta

SEQ ID NO: 785202 - DNA, 522 bp, Homo sapiens
  misc_feature: HIJSMM301BJIPY.14.19.B08.1.454.light.4.raw
  modified_base (455)..(455): a, c, t, g, unknown or other
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcagggtccctgaccgattctctggctccaaggctggcacctcagcctccctggccatcagtgggctccggtccgaggatgaggctgattattactgtgcagcatgggatgacagcctgagtggtccttgggtgttcggcggaggaccaagcngaccgtctaagtcagcccaaggcctgccccctcggtccacttcctcgttccccaccctcccttcccg

SEQ ID NO: 785203 - DNA, 515 bp, Homo sapiens
  misc_feature: HIJSMM301ECENS.51.82.H05.1.454.light.4.raw
cgatcgtatacacgaccggtgctcgatttagtcgagctctctcgcgggcacgaccggtgctcgatttagtcgagctctctcgcgggggaggaactgctcagttaggacccagagggaaccatggaagcccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccaggggccatggcatcccagcccaggttcagtggcagtgggtctgggacagacttcggctctcaccatcagcagcctagagcctgaagattttgctagttttattattgtcagcagacgaaacaactggcctccttggacgttcggcctaagggaaccgaaggtaggaaataaccg

SEQ ID NO: 785204 - DNA, 509 bp, Homo sapiens
  misc_feature: HIJSMM301BADY7.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatactaacaatcagcaacacttatgtctcgggactgggaccaagatcaccgtcctaggtcagccccaaggacccaacccccactgtcta

SEQ ID NO: 785205 - DNA, 515 bp, Homo sapiens
  misc_feature: HIJSMM301E1W8E.8.28.C06.1.454.light.4.raw
ctcgcgtgtccacgaccggtgctcgatttagagctcacgtattgggtttggggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcaggtgggtctgggacttcgttcactctcaccatcaaaaatacctgcaatctgacgacttttgctagttttatttcttgtcagcagtctgaagactggccgttcactttcgggcggagggaccaaggtcggacctcaaacgaactgtggctgcaccatctgtcttcatcttcccgcc

SEQ ID NO: 785206 - DNA, 506 bp, Homo sapiens
  misc_feature: HIJSMM301CWPUF.9.12.B01.1.454.light.4.raw
  modified_base (475)..(475): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatacaaacgaactagnggctagcaccatctgtcttctatcttccccg

SEQ ID NO: 785207 - DNA, 508 bp, Homo sapiens
  misc_feature: HIJSMM301ADREB.48.62.F07.1.454.light.4.raw
agtatacatacacgaccggtgctcgatttagtagtcgcataaagggaaagggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagtattttgcagtgtattactgtcagcagtatggtagctcaccgatccacctcggccaagggacacgactggagattaaccgaactgtggctgcaccatctgtcttcactcttccccg

SEQ ID NO: 785208 - DNA, 524 bp, Homo sapiens
  misc_feature: HIJSMM301BQXF4.43.19.B08.1.454.light.4.raw
tgtgagtagtcacgaccggtgctcgatttagtgagtcagtaagggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctcaactctggcaacacggccaccctggccatcagcagggtcgaagccggggatgaggccgactattactagtcaggtgtgggataatggtaggtgatcatccggtcttcggcggagggaccaagttgaccgtctaacgtcagcccaaggctcgccccctccggtccacttcctgttcccctacccctcctccta

SEQ ID NO: 785209 - DNA, 496 bp, Homo sapiens
  misc_feature: HIJSMM301AEG2I.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctggaggattttgcagtgtattactgtcagcagtatcataggtcaaacacctcggccaagggacacgactggagagttaaaggaactgtggctgcaccatctcgtcttcatcttccccg

SEQ ID NO: 785210 - DNA, 501 bp, Homo sapiens
  misc_feature: HIJSMM301CRP55.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcagggtattcctgagcgattctctggctccagttctgggaacacagccactctgaccatcagcgggacccaggcctatggatggaggctgactattactgtcaggcgtgggacatcagcaggtggaggttgggtttttccgggcgggtaggggaccaaaggctgacccggtcctaacgtcacgtaccccgg

SEQ ID NO: 785211 - DNA, 512 bp, Homo sapiens; identical to SEQ ID NO: 540108
  misc_feature: HIJSMM301AIPCA.40.12.B01.1.454.light.4.raw

SEQ ID NO: 785212 - DNA, 490 bp, Homo sapiens; identical to SEQ ID NO: 538999
  misc_feature: HIJSMM301ATFIM.16.86.H09.1.454.light.4.raw

SEQ ID NO: 785213 - DNA, 481 bp, Homo sapiens
  misc_feature: HIJSMM301EJDM3.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacaggcagcactcgcccgctatcgtcttcggaactgggaccaaggtccaccggtcctaagtcagaccccg

SEQ ID NO: 785214 - DNA, 514 bp, Homo sapiens
  misc_feature: HIJSMM301AYVRO.40.57.F02.1.454.light.4.raw
  modified_base (323)..(323): a, c, t, g, unknown or other
tctagcgactcacgaccggtgctcgatttagctcgatatagttggggtttgggggggggtctcaggaggcagcactctcgggacgtccccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctnaggggtcgctgatcgcttctctggctccaagtctggcgacacggccctccctgaccatctctgggctccagactgaggatgaggctattattttgctgctcttatgcaggctagtttcgcttctcgtaagtggttcggcgggagggaccgagctgaccgtcctacgtcacgcccaaggcctcgtccccccg

SEQ ID NO: 785215 - DNA, 507 bp, Homo sapiens
  misc_feature: HIJSMM301DW1RJ.41.53.E09.1.454.light.4.raw
tctatactatcacgaccggtgctcgatttagagagagtgtgttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggactagtcgatcaccatctcctgcactggaaccagcagtgacgttggtggttataactatgtctcctggtaccaacagcacccaggcaaacgcccccaaactcatgatttatgatgtcagtaatcggccctcaggggtttctaatcgcttctctggctccaagtctggcaacacggcctccctgaccatctctgggctccaggctgaggacgaggctgattattctagtcagctcatatacaacgcaaggcagcactctcgtggtattcggcggaggaccaagctgaccgtcctaggtcagcccaaggctcccg

SEQ ID NO: 785216 - DNA, 524 bp, Homo sapiens; identical to SEQ ID NO: 751593
  misc_feature: HIJSMM301A5K5N.5.27.C05.1.454.light.4.raw

SEQ ID NO: 785217 - DNA, 472 bp, Homo sapiens
  misc_feature: HIJSMM301AGGYP.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgtattttgactaacttactactgtcaacagagttccactaccccaatcactttcgtcctggactgaagtgcatatgaagagaactgtgg

SEQ ID NO: 785218 - DNA, 496 bp, Homo sapiens
  misc_feature: HIJSMM301DLN6K.40.81.H04.1.454.light.4.raw
tctagcgactcacgaccggtgctcgatttagtagtgtagattcgcggggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacacttgaaaatcagcagggtggaggcagaagatgttgggatttattactgcatgcaacctctacaaactgtgtggacggtcggccaagggaccaaggtggaaatcaagcgaactgtggctgcaccta

SEQ ID NO: 785219 - DNA, 496 bp, Homo sapiens
  misc_feature: HIJSMM301DSDKC.9.76.G10.1.454.light.4.raw
tgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctcccaaactcctcatctattatgatgatctgctgccctcaggggtctctgaccgattctctggctccaagtctggcacctcagcctccctggccatcagtgggctccagtctgaggatgaggctgatttattactgtggagcatgggatggacagcctgaatgcgttggattggttcggcgggacgggaccgaaagctcgaaccgttccctaaggtcagtccgaaac

SEQ ID NO: 785220 - DNA, 512 bp, Homo sapiens
  misc_feature: HIJSMM301BPI32.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgatttattactgcaggtcatataacaatcagcaaacacttatgtcttcggactgggaaccagatcaccgtccgtaggtcacgcccaaggcccaacccactcgtctaccg

SEQ ID NO: 785221 - DNA, 512 bp, Homo sapiens
  misc_feature: HIJSMM301CC271.4.57.F02.1.454.light.4.raw
  modified_base (64)..(64): a, c, t, g, unknown or other
  modified_base (417)..(417): a, c, t, g, unknown or other
  modified_base (497)..(497): a, c, t, g, unknown or other
  modified_base (506)..(506): a, c, t, g, unknown or other
agcactgtagcacgaccggtgctcgatttagctcgatatagttgggtttgggggcctaaggaancagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactagttactgtcaggtgtggganagtagtggtgatcatccatacgtcttcggaactgggaccaagggtctccgtcctacgtctagcccaaggccaaccccacntcgactctntcccgt

SEQ ID NO: 785222 - DNA, 489 bp, Homo sapiens
  misc_feature: HIJSMM301CX80C.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtcccaagaacttttggccaggggaccaagcctggagatacaacgaactggtggctgcaccat

SEQ ID NO: 785223 - DNA, 505 bp, Homo sapiens
  misc_feature: HIJSMM301BFBCD.18.59.F04.1.454.light.4.raw
tacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatcgtcttcggaactgggaccaaggtcaccgtcctaggtcacgcccaaggccaaccca

SEQ ID NO: 785224 - DNA, 513 bp, Homo sapiens
  misc_feature: HIJSMM301BJ9GY.17.28.C06.1.454.light.4.raw
cgtagactagcacgaccggtgctcgatttagagctcacgtattgggtttgggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccgggtccctgaccgattctctggctccatgtctggcacctcagcctccctgaccatcagtgggctccggtccgaggatgaggctgattattactgtgcaccgtggatgactatcctgaatggtccgggtgttcggcggagggaccaggctgaccgtcctaagtcagcccaaggctcgtccccccg

SEQ ID NO: 785225 - DNA, 505 bp, Homo sapiens
  misc_feature: HIJSMM301C3070.48.13.B02.1.454.light.4.raw
agtatacatacacgaccggtgctcgatttagtctagcgacttccgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctcgccccccg

SEQ ID NO: 785226 - DNA, 513 bp, Homo sapiens
  misc_feature: HIJSMM301A038K.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgaggccggggatggaggccgactattattgtcaggtgtgggataagtggcagtgatcattgtcttattcggcggaagggaccacggctgaccgtcctaagtcagcccaaggctcgccccctcggtcactctcgtcccaccct

SEQ ID NO: 785227 - DNA, 503 bp, Homo sapiens
  misc_feature: HIJSMM301DETZD.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcacccctcaccatcaatagcctggaagctgaagatgctgcaacttattactgtcatcagagtactactttacctcaatgatcaccttcggccaagggacacgactggagattaaacg

SEQ ID NO: 785228 - DNA, 490 bp, Homo sapiens
  misc_feature: HIJSMM301AGDGF.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatcgtagggcagatttcactctcaccatcaatcacctgcaggctgaggtattttgctaacttactactgtcagcaggctaacaggctcgcccccaaccttcggccgaaggggacacgactggagattaaacgatgtggctgcaccatctgtt

SEQ ID NO: 785229 - DNA, 490 bp, Homo sapiens
  misc_feature: HIJSMM301BZX61.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggtcagtggcagtgggtctgggacagacttcactctcaccatccagcagactggagcctgaggattttgcagtgtattactgtcagcagtatcataggtacaaacaccttcggccaagggacacgactggagattaaaggaactgtggctgcaccatctgtcttcatctt

SEQ ID NO: 785230 - DNA, 501 bp, Homo sapiens
  misc_feature: HIJSMM301BORPG.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttagtcgggtgttcgggcgggggacaaggctgaccgtcctaggtcagcccaaggcctcgccccctcggtcactctcgtt

SEQ ID NO: 785231 - DNA, 508 bp, Homo sapiens
  misc_feature: HIJSMM301APT62.17.87.H10.1.454.light.4.raw
  modified_base (493)..(493): a, c, t, g, unknown or other
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctcctgacaatctctggctccaggctgaggacgaggctgattattactgctgctcatatcaagtcgtgtcactatgtattttggcgggagcaccgaaggtcgacctccgtagtcacgacccaaggcnccgccccctcgtcta

SEQ ID NO: 785232 - DNA, 501 bp, Homo sapiens
  misc_feature: HIJSMM301BZ0PZ.9.81.H04.1.454.light.4.raw
  modified_base (494)..(494): a, c, t, g, unknown or other
tgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtctagtcagcccaaggccaaccccacncgtcact

SEQ ID NO: 785233 - DNA, 513 bp, Homo sapiens
  misc_feature: HIJSMM301AZTXR.22.21.B10.1.454.light.4.raw
acatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctggggcccagtctgccctgactcagcctccctccgcgtccgggtctcctggacagtcagtcaccatctcctgcactggaaccagcagtgacgttggtggttacaagtatgtctcctggtaccaacaccacccaggcacagccccccaaactcatgatttatgaggtcactaagcgggcctcaggggtccctgatcgcttctctggctccaagtctggcgaccacggcctccctgaccgtctctgggctccaggctgaggatgaggctgattatactgctactcatatgcaggcggcaactcttgggtgttcggcgggagggaccaagctgaccgtcctaggtcagcccaaggcctcgccccctcggtcactcttccg

SEQ ID NO: 785234 - DNA, 505 bp, Homo sapiens
  misc_feature: HIJSMM301AICE0.12.67.G01.1.454.light.4.raw
atacgacgtacacgaccggtgctcgatttagagtatacatattgggttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagccacccttcttttcgtcttcggaagtcgggaccaaggtccaccgtcctacgtcagcccaaggccaatccc

SEQ ID NO: 785235 - DNA, 495 bp, Homo sapiens
  misc_feature: HIJSMM301A12AR.51.19.B08.1.454.light.4.raw
cgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattatttatgaggccagtaggcgagcctcagggatttctagtcgcttctctgcctccgcgtctggcaacacggcctccctgacaatttctgggctccagcctgaggacgagtctcactactactgctcctcatatgcagacatagttcctggtgttcggcggaggaccagttgaccgtctaggtcagccaagctgcccctcggtcacttc

SEQ ID NO: 785236 - DNA, 531 bp, Homo sapiens
  misc_feature: HIJSMM301ADINY.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattatttgtagttcatatacaaccagtgacacttgggtggttcggcgggagggaccgaggctgaccgtccgtaggtcagcccaacggcctcgtcccccgtccggtcctactctcgttcccc

SEQ ID NO: 785237 - DNA, 509 bp, Homo sapiens
  misc_feature: HIJSMM301E10HO.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctggaggacgaggctgatttattactgcagcttatatacaggcaacaattacttttgtcttcggaactgggaccaaggtcaccgtcctaggtcacgacccaaggccaaccccactcgtcactctcgttccccgccccttcctccgagtagtacca

SEQ ID NO: 785238 - DNA, 507 bp, Homo sapiens
  misc_feature: HIJSMM301DPZDS.16.46.E02.1.454.light.4.raw
  modified_base (439)..(439): a, c, t, g, unknown or other
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgtcctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgatttattactgcagctttataatacaaggcaanaattactttgtcttcggactgggaccagtcaccgtcctaggtcagcccaaggccaacccactgtcact

SEQ ID NO: 785239 - DNA, 495 bp, Homo sapiens
  misc_feature: HIJSMM301E29OM.26.12.B01.1.454.light.4.raw
  modified_base (468)..(468): a, c, t, g, unknown or other
  modified_base (484)..(484): a, c, t, g, unknown or other
  modified_base (487)..(487): a, c, t, g, unknown or other
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccacgggccactggtatcccggccagattcagtggcagggggtctgggacagaattcactctcaccatcacagcctgcagtctgaagattttgcagtctattactgtcagcaatataattactggctctctttcggtcgggggaccgaagctggagancaaccgaactgtggcngcncatctgtt

SEQ ID NO: 785240 - DNA, 514 bp, Homo sapiens
  misc_feature: HIJSMM301D6Q9T.5.58.F03.1.454.light.4.raw
atcagacacgcacgaccggtgctcgatttagtctgatcgagaaggggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttgggggttataaccttgtctcctggtaccaacagcaaccaggcaaagcccccaaacttttgtttatcagggcaataagcggccctcagggtttctaatcgcttctctggctccaagtctggcaacacggccgccctgacaatctctgggctccaggctgacgacgaggctgtatttttactgctgctcatatgcaggtgaatcactacttttatgtttcgggactggaccaaggtcaccgtcctgtcagcccaaggccaacccactgtcactctccg

SEQ ID NO: 785241 - DNA, 463 bp, Homo sapiens
  misc_feature: HIJSMM301CT44L.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaggctcgccccctcggtcactctcgttcccgccctcctcaccgcgtatgt

SEQ ID NO: 785242 - DNA, 504 bp, Homo sapiens
  misc_feature: HIJSMM301DSZ0U.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgactagtttattactgtcagcagcgtatcgactggaatcaccttcggccaagggacacgactggaaattaaacgaactagtggctgcaccatctgtcttcatcttccccg

SEQ ID NO: 785243 - DNA, 457 bp, Homo sapiens
  misc_feature: HIJSMM301EES0L.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacaggtgtggaacggtccggttttcggcggagggaccaagctgaccgtcctaagtcagcccaaggctcgccccctcggtcactcctgttcccaccctcctccacgagata

SEQ ID NO: 785244 - DNA, 505 bp, Homo sapiens
  misc_feature: HIJSMM301D86CH.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgagggcactaagcggccctcaggggtttctggatcgcttctctggctccaagtctggcaacacggcctccctgaccaatctctgggctccaggctgaggacgaggctgattattattgctgctcatatgcaggtagttacacttatgtcttcggaatttgggactaggtccaccgtcctaggtcagcccaaggcccaaccc

SEQ ID NO: 785245 - DNA, 493 bp, Homo sapiens
  misc_feature: HIJSMM301EP4NY.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacaggggccactggcactcccagcccaggttcagtggcagtgagtctgggacagacttcactctcaccatcagcagcctagacgcctagaagtattttgctactttattactgtcagcagcgtagcaactcggccttctcactttcggcggagggccgaggggtggagatcagacgaa

SEQ ID NO: 785246 - DNA, 548 bp, Homo sapiens
  misc_feature: HIJSMM301BZMDW.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaagtcccggggtccctgaccgattcagtggcagcgggtctgggacagatttcactctcaccatcagcagcctgcaggctgaagatggtggctagtttattattgtcagcaattattatactttaccctcctacaggtaaccggtttcggacccgtaaaggggacccgaaaagggtacgggtaaaataccaaaaaccggaaacttcggtagggccttggccaacccgt

SEQ ID NO: 785247 - DNA, 519 bp, Homo sapiens
  misc_feature: HIJSMM301APFGZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttctcgggtcgttcggccgaacgggaccgaacggtaggaaagtacaaaacgaacgtagtggcgttgcaccatctgtcttctactcttccccg

SEQ ID NO: 785248 - DNA, 504 bp, Homo sapiens
  misc_feature: HIJSMM301BP2VK.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaactctgcggactttcggcccgtcgggtaccaaacggtggagactcaaacgaacttgtaggcgtgcaccatctagtcttt

SEQ ID NO: 785249 - DNA, 529 bp, Homo sapiens
  misc_feature: HIJSMM301EWY6Q.7.87.H10.1.454.light.4.raw
  modified_base (294)..(294): a, c, t, g, unknown or other
  modified_base (301)..(301): a, c, t, g, unknown or other
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtncatccanaagggccactggcatcccagacaggttcagtggccgtgggtctgggacagagttcagtctcaccatcagcagactggagcctgaagattttgcagtatattactgtcagcaatatggtacttcaccccggacgtcgtcacggacgacggtaggagtacgaacgaaacgtagtaggtcgtcgcgtaccactactcgtcttctacttacttcccgtccctactctcgtac

SEQ ID NO: 785250 - DNA, 512 bp, Homo sapiens
  misc_feature: HIJSMM301APKI9.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctggaggacgaggctgattactactgctgctcattatgcaggtcgtatcttcttatgttcttcggaactgggaccaaggtcaccgtcctaggtcagcccaacggccaaccccactgtcta

SEQ ID NO: 785251 - DNA, 506 bp, Homo sapiens
  misc_feature: HIJSMM301AG2OV.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcgaggaacagtagtcacgttgaccatcagtggagtccaggcagaagacgaggctgactattattgtcaagcagtagacagcagtggtccttagtcgggtggttcgggcgggggaccgaaggctgaccgtcctaggtcacgcccaaggctcgccccctcggtcacctctcgtt

SEQ ID NO: 785252 - DNA, 496 bp, Homo sapiens
  misc_feature: HIJSMM301BGG33.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggaagattaaaaggaactgtggctgcaccatctgtcttcatcttccccg

SEQ ID NO: 785253 - DNA, 450 bp, Homo sapiens
  misc_feature: HIJSMM301BQ79D.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctggttcggcggcgggaccaagttcgaccgtcctacgtcacgcccaaggcctcgccccctcggtcactctcgttccccaccctcctcgacacgcga

SEQ ID NO: 785254 - DNA, 362 bp, Homo sapiens
  misc_feature: HIJSMM301AV7SB.3.57.F02.1.454.light.4.raw
agacgcactccacgaccggtgctcgatttagctcgatatagttgggtttggggggtgtggtggtctccactcccgccttgacggggctgctatctgccttccaggcccctatcctggtcatcaattatgacagcgaccggccctcagggatccctgagcgattctctggctccaatctgggaacacggccaccctgaccatcaccagggtcgaggccgaggatgaggccgactattactgtcaggtgtgggatagccgttctgatcattgggtcttcggcggcgggaccaagctgaccgtctatgtcaacccaaggctggcccctcggtcactctgtttcccaccctcctcgaagtgcgtct

SEQ ID NO: 785255 - DNA, 501 bp, Homo sapiens
  misc_feature: HIJSMM301A473A.48.26.C04.1.454.light.4.raw
agtatacatacacgaccggtgctcgatttagtctagcgacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattggcggagggaccaagctgaccgtcctaggtcagcccaaggctgcccccc

SEQ ID NO: 785256 - DNA, 517 bp, Homo sapiens
  misc_feature: HIJSMM301EV9X0.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgacccagcctccctccgcgtccgggtctcctggacagtcagtcaccatctcctgcactggagccagcagtgattacaactatatctcctggtaccaacaacacccaggcaaagcccccaaactcatgattttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaaggttgaccgtcctaggtcagcccaaggctgccccctcggtcactctgttcccaccctcctaccg

SEQ ID NO: 785257 - DNA, 445 bp, Homo sapiens
  misc_feature: HIJSMM301AMGIO.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggatgaggctgattattactgccactcctatgacagcagcctagagaagtgtggtattcggcggagggaccaagctgaccgtcctaggtcagcccaaggctgccccctcggtcactctgttcccaccctcctcagaccgtatca

SEQ ID NO: 785258 - DNA, 490 bp, Homo sapiens
  misc_feature: HIJSMM301AWQK8.49.46.E02.1.454.light.4.raw
  modified_base (365)..(365): a, c, t, g, unknown or other
agtcgagagacacgaccggtgctcgatttagactcatctacaggggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctnaccatcagcagcctagagcctgaagattctgcagtttattactgtcagcagcgtagcaactggcctctcactttcggcgggagggaccgaaggtggaggatcaaacgaactagtggctcgcacca

SEQ ID NO: 785259 - DNA, 522 bp, Homo sapiens; identical to SEQ ID NO: 638298
  misc_feature: HIJSMM301D9EKR.27.23.C01.1.454.light.4.raw

SEQ ID NO: 785260 - DNA, 505 bp, Homo sapiens
  misc_feature: HIJSMM301BA6EM.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttaggtaagatttctaatcgggattccggggtcccagacagattcagcggcagtgggtcaggcactgatttcacgctgaagatcagcgagggtggaggctgaggatgtttgcggttttattactgcctgcagagtattcactgggccgtgggacggttcggccgaacgggaccgaaggtaggaaagtacaaaacgaacctgt

SEQ ID NO: 785261 - DNA, 504 bp, Homo sapiens
  misc_feature: HIJSMM301D8AO3.3.21.B10.1.454.light.4.raw
agacgcactccacgaccggtgctcgatttagtgtcgtcgcaagagaggagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatagttcggcggagggaccaaggtgaccgtcctacgtcagcccaaggcctcgccccctcggtccactccttcg

SEQ ID NO: 785262 - DNA, 497 bp, Homo sapiens
  misc_feature: HIJSMM301BGF3C.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccaatctgtcttcactcttcccccg

SEQ ID NO: 785263 - DNA, 520 bp, Homo sapiens
  misc_feature: HIJSMM301DJW0E.41.19.B08.1.454.light.4.raw
tctatactatcacgaccggtgctcgatttagtgagtcagtaagggggctgggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccactgtcactctgttcccaccctcct

SEQ ID NO: 785264 - DNA, 551 bp, Homo sapiens
  misc_feature: HIJSMM301BRKB5.9.12.B01.1.454.light.4.raw
  modified_base (400)..(400): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaaactgggcatctacccggcaatccggggtccctgaccgattcagtggcagcgggtctgggacagatttcactctcaccatcagcagcctgcaggctgaaagntgtggctagtttattactgtcaactacgtttttcgtcggggtcgttacggtccctaacgggaaccgaacggtagggtaaagtacctaaaaccggaaaccttaggtgggccttaggcaccgaactcttggtctttccacttcctttcccccc

SEQ ID NO: 785265 - DNA, 528 bp, Homo sapiens
  misc_feature: HIJSMM301D3MVT.11.58.F03.1.454.light.4.raw
cgagagataccacgaccggtgctcgatttagtctgatcgagaagggaaagggggggaagcctgagaacacttagccttcatgagtgtccccaccatggcctggatgatgcttctcctcggactccttgcttatgggtcaggagtggattctcaggctttggtgacccaggagccatcgttctcagtgtcccctggagggacactcacactcacttgtggcttgagatacgggtcagtctctgttaattactacccagttggtaccgacagaccccaggccagcctccacgcacgctcatttataacacaaagactcgctcttctggggtccctaatcgcttctctggctccatccttgggaacaaagctgccctcaccatcacgggggcccagggcggacgatgaatctatttattattgtgtactttttgtgggtcgtggctattctgctgtgttcggcggaggcacccaggtgaccgtcctcggtcagcccaaggctcgcccatcggtcactctcgttcccaccct

SEQ ID NO: 785266 - DNA, 500 bp, Homo sapiens
  misc_feature: HIJSMM301DOBVF.46.35.D02.1.454.light.4.raw
actagcagtacacgaccggtgctcgatttagcacacgataggttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtacccaagtaacttttggccgaggggaccaagctggagatacaaacgaactgtggcgtgccactactcttcg

SEQ ID NO: 785267 - DNA, 486 bp, Homo sapiens
  misc_feature: HIJSMM301ATF05.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccagaactttggcgagggaccaagctggagatcaaacgaactgtggctgcacatcttcg

SEQ ID NO: 785268 - DNA, 524 bp, Homo sapiens
  misc_feature: HIJSMM301DB1PO.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctggaccgtcctaggtccagcccaaggctgccccctcggtcactctcgttcccaccct

SEQ ID NO: 785269 - DNA, 504 bp, Homo sapiens
  misc_feature: HIJSMM301BBZZT.48.82.H05.1.454.light.4.raw
agtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgctttctctggctccaagtctggcaacacggcctccctgaccatcttctgggctccaggctgaggacgaggactgattattactgcactcatatacaagcagcagcactctcgtgtattcggcggagggaccaagctgaccgtccttaggtcagcccaaggctcgccccctcc

SEQ ID NO: 785270 - DNA, 482 bp, Homo sapiens
  misc_feature: HIJSMM301BEONS.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcaggcgggacccaggcttagtggatggagctgactattactgtcaggcgtgggacatcagcagtgaggttggtttcggcggagggaccaagctgaccgtctaagtcgagacccg

SEQ ID NO: 785271 - DNA, 516 bp, Homo sapiens
  misc_feature: HIJSMM301CG7NO.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgccaggctgaggtattttgcaacttactactgtcagcaggctaacaggctcgccccccaacccttccggtacccgaggggaccgaacggacctaggagaagttaaacgaaacctaggttggcgtgtcgacctactcttcgtt

SEQ ID NO: 785272 - DNA, 524 bp, Homo sapiens
  misc_feature: HIJSMM301CVZ24.15.57.F02.1.454.light.4.raw
tctacgtagccacgaccggtgctcgatttagctcgatatagttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcagggtatctaatcgcttctctggctccaagtctggcaacacggcctccctgaccgtctctggcctccagactggaggacgaggctgattattactgccactcatatagaagtagtactactcctgtggtttcgggcggagggaccaagctgaccgtcctaggtcacggcccaaggctcgcccccgtccggtcacctcgttccg

SEQ ID NO: 785273 - DNA, 494 bp, Homo sapiens; identical to SEQ ID NO: 534992
  misc_feature: HIJSMM301BPWFZ.9.1.A01.1.454.light.4.raw

SEQ ID NO: 785274 - DNA, 481 bp, Homo sapiens
  misc_feature: HIJSMM301BPXRF.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcggtgggacagcagcactgcccgctatgtcttcggaacgtgggaccaaggtcaccgtcctaagtcacgaccccg

SEQ ID NO: 785275 - DNA, 514 bp, Homo sapiens
  misc_feature: HIJSMM301EYPHS.9.71.G05.1.454.light.4.raw
tgatacgtctcacgaccggtgctcgatttagtgtcgtcgcaagagagaggggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagccccacactcttaatttatgaggtcactaagcggccctcaggggtttctggtcgcttctctgcctccaagtctggcaacacggcctccctgacaatctctgggctccagtctgacgacgaggctgattattactgcagctcatatgctagttggtttcctcttttcaagtatatttcggcggagggaccagggctggaccgtcctggagtcagcccaaggctcgtccccccg

SEQ ID NO: 785276 - DNA, 460 bp, Homo sapiens; identical to SEQ ID NO: 537107
  misc_feature: HIJSMM301DNWCH.22.28.C06.1.454.light.4.raw

SEQ ID NO: 785277 - DNA, 524 bp, Homo sapiens
  misc_feature: HIJSMM301DBBE4.52.67.G01.1.454.light.4.raw
  modified_base (505)..(505): a, c, t, g, unknown or other
cgcagtacgacacgaccggtgctcgatttagagtatacatattggggtttgggggatcaggactcctcagttcaccttctcacaatgaggctccctgctcagctcctggggctgctaatgctctgggtcccagcatccactggggatgttataatgactcagtctccactctccctgcccgtctcccttggacagccgacctccatctcctgcaggtctagtcaaggcctcgttttcagtgatggaacacctacttgaattggtttcaccagaggccaggccaacctccaaggcgcctatttataaggtttctaagcgggactctggggtcccagacagattcagcggcagtgggtcaggcactgatttctcactgcaaatcagcggggtggaggctgaggatggttggggtttattacgtgcatgcaagggtacacactggcctccggacgttcggccgaaggaccaaggtcggaaatcaaacgaactcgtgggctggcacctntctgtcttcatcttccccg

SEQ ID NO: 785278 - DNA, 518 bp, Homo sapiens
  misc_feature: HIJSMM301CMNXY.47.55.E11.1.454.light.4.raw
  modified_base (499)..(499): a, c, t, g, unknown or other
agctcacgtacacgaccggtgctcgatttagcactcgcacgtagggtcttgggcccagtctgtgctgactcagccaccctcagcgtctgggacccccgggcagacggtcaccatctcttgttctggtaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaaggggtgcagagaactccatggctaccagggtcagcccaagggccaacccgactgtcactcctcgttcccncccgtcctacgtacgtgag

SEQ ID NO: 785279 - DNA, 492 bp, Homo sapiens
  misc_feature: HIJSMM301EVI6U.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctccaggctcctcatctatgctgcatccatcagggccactggcatcccaggcagattcagtggcaggtgggtctgggacagacttcactctcaccatcagcagactggacgcctgaagtattttgctagtctattactgtcagcagtatggtcacgtcccaagtaacttttggccgaggggaccaagctggagatacaaacgaactgtggctgcaccat

SEQ ID NO: 785280 - DNA, 495 bp, Homo sapiens
  misc_feature: HIJSMM301CA5QO.8.4.A04.1.454.light.4.raw
ctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcaacaaacattcgcacttctggggtccctgatcgcttctctggctccatccttgggacaaagctgccctcaccatcacgggggcccaggccagatgatgaatctcattattactgtgcactgcatttgcgtgatgtcaattatgttgttcgggcggagggaaccg

SEQ ID NO: 785281 - DNA, 511 bp, Homo sapiens
  misc_feature: HIJSMM301DJAT8.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggctagtttattattgtcagcaatattatattcctcctcagtacgttcggccaagggaccgaaggtacggaaatacgaaaacgaacttggtcggctcgcaccgta

SEQ ID NO: 785282 - DNA, 463 bp, Homo sapiens; identical to SEQ ID NO: 758137
  misc_feature: HIJSMM301BFUCQ.22.28.C06.1.454.light.4.raw

SEQ ID NO: 785283 - DNA, 519 bp, Homo sapiens
  misc_feature: HIJSMM301CKDFU.17.33.C11.1.454.light.4.raw
  modified_base (484)..(484): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggccngccccctccggtcacctctcttcccgccctccctt

SEQ ID NO: 785284 - DNA, 488 bp, Homo sapiens
  misc_feature: HIJSMM301ANZHQ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgctaacttactactgtcaacagagttacagtacccccctcacttcggcggagggaccaaggcggagatcagacaactgtggctgcaccatctgtcttcta

SEQ ID NO: 785285 - DNA, 529 bp, Homo sapiens
  misc_feature: HIJSMM301BO25Z.40.22.B11.1.454.light.4.raw
tctagcgactcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcaggtggatcaggtacagattttacactagaaaatcagcagagtggaggctggaggatgttggggtttattactgcatgcaagctctaacaaattcctccggtaacgttccggtaccgaagggaccaacggtaggtaaaagtacaaaacgaaacgtaggttacggcgtcggcacctaacgtccttcg

SEQ ID NO: 785286 - DNA, 504 bp, Homo sapiens
  misc_feature: HIJSMM301CIIKK.40.57.F02.1.454.light.4.raw
tctagcgactcacgaccggtgctcgatttagctcgatatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctcgggctccagacctgaggatgaggctacttatttttgctgctcttatgcaggcagtttcgctctcgaagtgttcggcggagggaccgagctgacccgtcctacgtcacgcccaaggtcccg

SEQ ID NO: 785287 - DNA, 501 bp, Homo sapiens
  misc_feature: HIJSMM301D5RG7.40.83.H06.1.454.light.4.raw
tctagcgactcacgaccggtgctcgatttagatcacgtgcgtcgcgggggctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactagttcagcatcgggacggcagcctcagtggaagtggggtcggttcgggcgggacgggacctaaacgtggtcccgtccgtaggtccacc

SEQ ID NO: 785288 - DNA, 459 bp, Homo sapiens
  misc_feature: HIJSMM301APQ0G.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccgccctcctcacgcgtatg

SEQ ID NO: 785289 - DNA, 487 bp, Homo sapiens; identical to SEQ ID NO: 682008
  misc_feature: HIJSMM301A932H.10.53.E09.1.454.light.4.raw

SEQ ID NO: 785290 - DNA, 504 bp, Homo sapiens
  misc_feature: HIJSMM301C3YWO.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagacgtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagttattactgtcagcagcgtagcaactggcctttcactttcggcccggggaccgaaacgtggaaatacaaacgaactgtggctgcaccatctgtcttcactcttcccgccat

SEQ ID NO: 785291 - DNA, 504 bp, Homo sapiens
  misc_feature: HIJSMM301EUMY8.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagcttggttaatttggtatcaagcagaaagcaggaaaagcccctaacctcctgatcaagggtccgtccagtttccagagtggggcctcaacaaggttcagcggcagtggatctgggacagatttcacttctcaccatcaccagcctgcagcctgaagattttgcaacttactattgtcaacaggctgacaggttcccgctgactttcggcggagggaccaaggtagagatcaaaggaactgtggctcggcaccatctgttcttcatcttcccg

SEQ ID NO: 785292 - DNA, 506 bp, Homo sapiens
  misc_feature: HIJSMM301ARD3P.3.33.C11.1.454.light.4.raw
agacgcactccacgaccggtgctcgatttagagtgagctcgttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggaccctcaggggtccctgatcgcttctctgcctccaagtctggcaacacgtcctcctgaccgtctctgggctccagcctgaggatgaggctgattattactgcagctcatatgcaggcatcaactactgttttcggacggacgggaccaagctgaccgtcctaggtcacgcccgaaggctcgtccccccg

SEQ ID NO: 785293 - DNA, 508 bp, Homo sapiens
  misc_feature: HIJSMM301ATXO7.22.25.C03.1.454.light.4.raw
acatacgcgtcacgaccggtgctcgatttagtagtgtagatttgggtttggggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctacgtttaaaaactggtgtcccatcaaggttcagcggcagtggatctgggacagaattcactctcgccatcagcagcctgcagcctgatgattctgcaacttattactgaccaacagtattatagttatcgggggacgttcgggaccaacggggaccaaggtggaaaagtcaaaacgaactaggtcggcgtgccaccatctgtt

SEQ ID NO: 785294 - DNA, 503 bp, Homo sapiens
  misc_feature: HIJSMM301BZHE1.3.33.C11.1.454.light.4.raw
agacgcactccacgaccggtgctcgatttagagtgagctcgttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaactactgttttcggcggtagggaccaagctgaccgtctacggtcagcccaaggctcgtccccccg

SEQ ID NO: 785295 - DNA, 486 bp, Homo sapiens
  misc_feature: HIJSMM301DWHPK.49.46.E02.1.454.light.4.raw
  modified_base (431)..(431): a, c, t, g, unknown or other
  modified_base (470)..(470): a, c, t, g, unknown or other
agtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctntcacttggcgagggaccaaggtggagatcaaacgaactntggctgcacatctgtt

SEQ ID NO: 785296 - DNA, 498 bp, Homo sapiens
  misc_feature: HIJSMM301D4THQ.10.11.A11.1.454.light.4.raw
catagtagtgcacgaccggtgctcgatttagctacgactgcgaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggcccccagactcatcatttctgatgtcagtgatcggccctttgggatttctaatcgcttctctgcctccaagtctggcaacacggcttccctgaccatctccgggctccgacgctgaggacgaggctcattattactgcagctcatactacacccgagggcaactctcgtgaatagttcggcggtacgggacctggctcgaccgtcctacgtcagt

SEQ ID NO: 785297 - DNA, 441 bp, Homo sapiens
  misc_feature: HIJSMM301BHH49.41.9.A09.1.454.light.4.raw
  modified_base (423)..(423): a, c, t, g, unknown or other
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctggtcactctcgttcccnccctcctcatagtataga

SEQ ID NO: 785298 - DNA, 507 bp, Homo sapiens
  misc_feature: HIJSMM301EF42E.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgacccatctctgggctcgagtctgaggacgagctgattacttctgttgctcttggcaactactgtcgtttgggtgttcggcggacgggacaagttgaccgtctaggtcagcccaaggctgccccctcggtcactctgtt

SEQ ID NO: 785299 - DNA, 499 bp, Homo sapiens
  misc_feature: HIJSMM301DSKYU.19.78.H01.1.454.light.4.raw
  modified_base (394)..(394): a, c, t, g, unknown or other
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaaataaagcccccaaactcatcatttatgatgccactaagcggccctcaggggtttctaatcgcttctctggctccaagtctggcaacacggcctccctgacaatctctgggctccaggctgaggcgaggctgattactactgctgctcatatgcnggtcgtatctcttatgtcttcggaactgggaccaaggtcaccgtcctaggtcagcccaaggccaaccccactgtcactctgttcccgccctcctccacgagagta

SEQ ID NO: 785300 - DNA, 485 bp, Homo sapiens
  misc_feature: HIJSMM301BKXSN.21.25.C03.1.454.light.4.raw
  modified_base (449)..(449): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcacgcctccctggtcatcgctgggctccaggctgacgatgaggctgattattattgcctagtcctatgacaacnccctgcgtggttttggtctgttcggtcggcggaccc

SEQ ID NO: 785301 - DNA, 498 bp, Homo sapiens
  misc_feature: HIJSMM301B3SFV.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcgcagtggatctgggacagatttcactctcgccatcagcagcctgcagactgaagtattttgctaactttattttgtcaacaggctaactactttccccctcactttcggcggacgggaccgtaaggtggagatcaaggcgaactgtggctgcaccatctgttctt

SEQ ID NO: 785302 - DNA, 514 bp, Homo sapiens
  misc_feature: HIJSMM301C1R5N.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgtatttttactgctgctcatatgcaggtgatcactacttttatgttcgggactgggaccaaggtcaccgtcctaggtcagcccaaggccaacccactgtcactctccg

SEQ ID NO: 785303 - DNA, 519 bp, Homo sapiens
  misc_feature: HIJSMM301DGP4O.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctggctgaagagtgaggacgaggctgactacttctgtcagtcttatgatataaacaattatagtgataattggcggagggaccagggtgaccgtccgtaggtcagcccaaggctgccccctcggtcactctgttcccg

SEQ ID NO: 785304 - DNA, 488 bp, Homo sapiens
  misc_feature: HIJSMM301ASDEE.49.34.D01.1.454.light.4.raw
  modified_base (405)..(405): a, c, t, g, unknown or other
agtcgagagacacgaccggtgctcgatttagatcgtctgtgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaanatgtggcagtgtattactgtcagccaatatcacactgctccgctcactttcggacggagggaccagggtggagatcaaaaccg

SEQ ID NO: 785305 - DNA, 506 bp, Homo sapiens
  misc_feature: HIJSMM301EXT8H.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccaggtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaactacacacggccgctcactttcggcggagggaccaaggtggagatcaaacgaactgtggctgcaccatctgtt

SEQ ID NO: 785306 - DNA, 466 bp, Homo sapiens
  misc_feature: HIJSMM301APLUI.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcgggagggaccgaggctggaccgtccgtaggtcacgcccaaggctgccccctcggtcactctcgttcccgccctcctcacgcgtatgt

SEQ ID NO: 785307 - DNA, 503 bp, Homo sapiens
  misc_feature: HIJSMM301AQPCE.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacacgcccccagggtcctcatctttggttacagtaatcggccctcaggggtccctgaccgattctctggctccaagtctgacacctcagccctccctggccatcactgggctccagactgaggatgaggctcattattactgccagttcttatgacaaacgtcagaactagtttgggttgttcggcggagggaccaaggctgacccgtcctcacgtcagaccccg

SEQ ID NO: 785308 - DNA, 516 bp, Homo sapiens
  misc_feature: HIJSMM301AX19T.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggccgtccgggggccacttcggccctcgggaccaaattgagatacaaacgaactagtggctgcaccactctcgtcttctactcttcccgt

SEQ ID NO: 785309 - DNA, 449 bp, Homo sapiens
  misc_feature: HIJSMM301D64PC.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccaacagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtaatgtcttcggatctgggaccaaggtcaccgtcctaagtcagcccaaggccaacccctctgtcactctcgttcccgccctcctccatactcgta

SEQ ID NO: 785310 - DNA, 493 bp, Homo sapiens
  misc_feature: HIJSMM301APVLX.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattacttgccaacagtatcatcatcattgtaatttcggtggagggacaaggtggaggtcaaacgaactgtggctgcaccatctgtcttcattcc

SEQ ID NO: 785311 - DNA, 479 bp, Homo sapiens
  misc_feature: HIJSMM301DFPEU.16.86.H09.1.454.light.4.raw
  modified_base (462)..(462): a, c, t, g, unknown or other
tgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcctaaggctcgccccctcggtcactctgttcccnccctcctcgatagtaca

SEQ ID NO: 785312 - DNA, 507 bp, Homo sapiens
  misc_feature: HIJSMM301CJEN9.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaaacagtaataacttatctttattgtcttcgggtatctgggaccaggggtccaccgtcctaacgggtcaagccccaaaggcccaaaccccccg

SEQ ID NO: 785313 - DNA, 513 bp, Homo sapiens
  misc_feature: HIJSMM301AYG7E.47.85.H08.1.454.light.4.raw
agctcacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctcgggctcgagtctgaggacgaggctgattactctgttgctctggtcaactactgtcgttggtggttcggtcggagggaccaagttgaccgtccgtaggtcagacccaagctcgccccctcggtccactctcgtt

SEQ ID NO: 785314 - DNA, 509 bp, Homo sapiens
  misc_feature: HIJSMM301BKOHY.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgtactttgctagtttatttctgtcagcagtctagaagactggccgttcacgtttcggcggacgggaccaaggtcggacctcaaacgaactgtggctgcacatctgtcttcatcttcccgc

SEQ ID NO: 785315 - DNA, 348 bp, Homo sapiens
  misc_feature: HIJSMM301BMRKY.21.87.H10.1.454.light.4.raw
tcgtcgctcgcacgaccggtgctcgatttagcagtactgcgttgggttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcactattttttcttggtttttggcggcgggacccagatgactgtcctcagtcagcccaaggcctgccccctcggtcactctcgttcccaccctcctccgagcgacga

SEQ ID NO: 785316 - DNA, 424 bp, Homo sapiens
  misc_feature: HIJSMM301AG5V1.10.86.H09.1.454.light.4.raw
catagtagtgcacgaccggtgctcgatttagtgctatagacgttgggggggtggagggttgagaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcgggcggagggactaagttgaccgtcctacgtcaggcccaaggctgccccctcggtcacctctgttcccaccctcctccactactatg

SEQ ID NO: 785317 - DNA, 507 bp, Homo sapiens
  misc_feature: HIJSMM301AU7H9.18.78.H01.1.454.light.4.raw
  modified_base (444)..(444): a, c, t, g, unknown or other
tacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcaagcacncaagtcttcggaactgggaccaaggtcaccgtcctaggtcagcccaaggccaacccactgtca

SEQ ID NO: 785318 - DNA, 500 bp, Homo sapiens; identical to SEQ ID NO: 596777
  misc_feature: HIJSMM301AZJ3J.19.78.H01.1.454.light.4.raw

SEQ ID NO: 785319 - DNA, 479 bp, Homo sapiens
  misc_feature: HIJSMM301D2VO5.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattaattgccagtcctatgacaacaccctgcgtggttttggctgtcggcggcggac

SEQ ID NO: 785320 - DNA, 509 bp, Homo sapiens
  misc_feature: HIJSMM301EJE6O.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctcccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgttgggaccgttcggccaagggaccgaaacggtggaaaattcaaaacgaactagtggctgcacc

SEQ ID NO: 785321 - DNA, 497 bp, Homo sapiens
  misc_feature: HIJSMM301E0WUR.17.55.E11.1.454.light.4.raw
cgtagactagcacgaccggtgctcgatttagcactcgcacgttgggtttgggggagctacaacaggcaggcaggggcagcaagatggtgttgcagaccccaggtcttcatttctctgttgctctggatctctggtgcctacggggacatcgtgatgacccagtcctccagactccctggctgtgtctctgggcgagagggccaccatcaactgcaagtccagccagagtgttttatacagctccaacagtaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtacagacaatattatagtactcctctctactttcggcggacgggaccgaaggtggagactacaaacgaact

SEQ ID NO: 785322 - DNA, 506 bp, Homo sapiens
  misc_feature: HIJSMM301B56YQ.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcgaggtcgtatctcttatgttcttcggaactgggaccaaggtcaccgtctaggtcagcccaaggcccaaccccactgtcta

SEQ ID NO: 785323 - DNA, 502 bp, Homo sapiens
  misc_feature: HIJSMM301AE9AO.26.72.G06.1.454.light.4.raw
agactatactcacgaccggtgctcgatttagctacgactgcaagggaaagggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgccaggctgaagatgtggcagtttattactgtcagcatatttcgtgctccgtactacttttggccgtacggggacccgaggtggagatcagacgaactgtggctgcaccatctgtcttcactccttcccg

SEQ ID NO: 785324 - DNA, 505 bp, Homo sapiens
  misc_feature: HIJSMM301BIA0F.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcacttgtctcctggtaccaacaccaccccggcagagccccccaaactcatgatttatgaggccactaagcgaccctcagggctttctaatcgcttctctggctccaagtctggcaacacggcctccctgacaatctctgggctccaggctgacgacgaggctaattattactgctgctcatatgaagttataacactatactattcggcggagggaccaagctgaccgtcctgcgtcagcccaaggctcgccccctcggtccacttcc

SEQ ID NO: 785325 - DNA, 485 bp, Homo sapiens; identical to SEQ ID NO: 539423
  misc_feature: HIJSMM301EQEQ6.46.35.D02.1.454.light.4.raw

SEQ ID NO: 785326 - DNA, 485 bp, Homo sapiens
  misc_feature: HIJSMM301C62CK.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtgggatctagggcagatttcactctcaccatcaatcacctgcaggctgaggattttgcaacttactactgtcagcaggctaacaggctgcccccaaccttccggaccaggggacacgactggagattaaacgaactgtggctgcacatct

SEQ ID NO: 785327 - DNA, 509 bp, Homo sapiens
  misc_feature: HIJSMM301DT4UB.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaaagcctggcccaggctccccagactcctcatctctgatacatccaacagggccactggcatcccagccaggttcagtggcagtgggtctgggacagacttcactctcaccatcagcgacctagagcctgaagattttgctagtttattactgtcagcagcgtagcatctggcctccgtcaccttggccagggaccaagctggagagtcaaacgtaactgtggctcgcgaccatctgtcttcattcccg

SEQ ID NO: 785328 - DNA, 478 bp, Homo sapiens
  misc_feature: HIJSMM301EAL13.7.81.H04.1.454.light.4.raw
cgtgtctctacacgaccggtgctcgatttagtagtgtagattcgcggggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggcctgggactgagtgcatatagtaagagaactgtggctgtca

SEQ ID NO: 785329 - DNA, 494 bp, Homo sapiens
  misc_feature: HIJSMM301AEDQE.3.10.A10.1.454.light.4.raw
  modified_base (432)..(432): a, c, t, g, unknown or other
  modified_base (475)..(475): a, c, t, g, unknown or other
agacgcactccacgaccggtgctcgatttagcgtcgatctcaggggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaaatcagcagacaacaagtaatattatntttatgtcttcggatctgggaccagggtcaccgtcctacggtnagcccaaggccaacccccg

SEQ ID NO: 785330 - DNA, 492 bp, Homo sapiens
  misc_feature: HIJSMM301A422V.14.55.E11.1.454.light.4.raw
  modified_base (428)..(428): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtgggtcccgtcaaggttcagtggcagtggatctgggacagatttcactctcaccgtcagcagtctgcaacctgaagattttgcaacttactaactgtcaacagtagttacagtacccccctntacctttcggcggagggaccaaggcggagatcagacgaactgtggctgcaccatctgtcttcta

SEQ ID NO: 785331 - DNA, 512 bp, Homo sapiens
  misc_feature: HIJSMM301ARZ7Z.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgtatttattactgcaggtcatatacaatcagcaacacttatgtcttcgggactgggaccaagatccaccgtcctaggtcacgcccaacggcccaaccccgactcgtcta

SEQ ID NO: 785332 - DNA, 515 bp, Homo sapiens
  misc_feature: HIJSMM301B8BM3.40.42.D09.1.454.light.4.raw
tctagcgactcacgaccggtgctcgatttagacacatacgcagggaaaggggggggcctaaggaagcagcactggtggtgcctcagccatggcctggaccgttctcctcctcggcctcctctctcactgcacagggtctgtgacctcctatgtgctttgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcagcgggacccaggctatggatgaggctgactattactgtcaggcgtgggacatcagcagtgaggtggttttcggcggagggaccaagctgaccgtctaagtcagcccaaggctcgccccctcggtcactctgttcccaccctcctc

SEQ ID NO: 785333 - DNA, 493 bp, Homo sapiens
  misc_feature: HIJSMM301D0O3A.22.57.F02.1.454.light.4.raw
  modified_base (472)..(472): a, c, t, g, unknown or other
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtgggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgnggctgcacatctgtcttcatt

SEQ ID NO: 785334 - DNA, 510 bp, Homo sapiens
  misc_feature: HIJSMM301CAMRC.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgacctcaggggtccctgatcgcttctctggctccaagtctggcaacacggcctccctgaccgtctctgggctccaggctgaggatgaggctgattattactgcagctcatatgcaggcagcagcagtccccatgtgatcgttcggcggggggaccaagctgaccgtcctaggtcagcccaacggctcgtccccccg

SEQ ID NO: 785335 - DNA, 447 bp, Homo sapiens; identical to SEQ ID NO: 535020
  misc_feature: HIJSMM301AXSQ4.18.9.A09.1.454.light.4.raw

SEQ ID NO: 785336 - DNA, 491 bp, Homo sapiens
  misc_feature: HIJSMM301EVNYB.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctctactttcggcggagggaccaagggtggacgatcaaaacgtaacg

SEQ ID NO: 785337 - DNA, 508 bp, Homo sapiens
  misc_feature: HIJSMM301DLE51.2.35.D02.1.454.light.4.raw
acgctcgacacacgaccggtgctcgatttagcacacgatagttgggtttagggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaacgcccccaaactcctcatttatgaggtcactaagcggcccttaggggtccctgatcgcttctctggctccaagtctggcagaacggcctcctgacctctctgggctccaagctgaggatgaggctgattattactgcagctcatatgcaggcagcagcaatgttactttcgggcggagggaccaagctgaccgtcgtgggtcagcccaaggcctcgccccctcggtctac

SEQ ID NO: 785338 - DNA, 505 bp, Homo sapiens
  misc_feature: HIJSMM301BWNPU.15.81.H04.1.454.light.4.raw
tctacgtagccacgaccggtgctcgatttagtagtgtagattcgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaaactcatgatttatgaggtcagtaatcggccctcaggggtttctaatcgcttctctggctccaagtctggcaacacggcctccctgaccatctctgggctccaggctgaggacgagggtgattattactgcagctcatataagaagtggcagcactctcgtattcggacggtgggaccaagctagaccgtcctaggtcagacccaaggctcgccccctcc

SEQ ID NO: 785339 - DNA, 490 bp, Homo sapiens
  misc_feature: HIJSMM301CLQ3M.9.59.F04.1.454.light.4.raw
  modified_base (466)..(466): a, c, t, g, unknown or other
tgatacgtctcacgaccggtgctcgatttagtacacacacttagggattggggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggtattttgctaacttactactagtcagcaggctaacaggctgcccccaacttcggccaggggacacgactgganattaaacgactgtggctgcaccat

SEQ ID NO: 785340 - DNA, 447 bp, Homo sapiens; identical to SEQ ID NO: 535201
  misc_feature: HIJSMM301BMONB.18.9.A09.1.454.light.4.raw

SEQ ID NO: 785341 - DNA, 499 bp, Homo sapiens
  misc_feature: HIJSMM301BNBIK.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattaattgtcaactagggtaacagtttcccgctcaccttcggcggagggaccgaaggtaggagatgaaaaacgaaatgtaggcgtgcgacctat

SEQ ID NO: 785342 - DNA, 512 bp, Homo sapiens
  misc_feature: HIJSMM301ANIYB.22.36.D03.1.454.light.4.raw
acatacgcgtcacgaccggtgctcgatttagctgcgtcacgatctctcttgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactggggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctactttattactgcagttcctttaaattaggcgccactcttcgtggttttcggcggaggcaccgaagtgaccgtcctcggtcacgccaaggctcgccccctcgg

SEQ ID NO: 785343 - DNA, 519 bp, Homo sapiens
  misc_feature: HIJSMM301DOJWS.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattaactgcctactctactttggtggtgctgtgctagttcggcggagggaccagctgaccgtcttaagtcagcccaaggcctgccccctcggtccactctcgttcccctaccccc

SEQ ID NO: 785344 - DNA, 528 bp, Homo sapiens
  misc_feature: HIJSMM301DF2BU.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggtcggagggaccaaaggctgaccggtccttacgggtcacgcccaacggctcgccccctccggtcactctcgtttcccccg

SEQ ID NO: 785345 - DNA, 499 bp, Homo sapiens
  misc_feature: HIJSMM301ADFN4.40.53.E09.1.454.light.4.raw
tctagcgactcacgaccggtgctcgatttagagagagtgtgttgggtttgggcacgaccggtgctcgatttagagagagtgtgttgggtttgggggccgttcctgggcccagtctgtgctgactcagccaccctcagcgtctgggaccccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtgttcggcgggggaccgaagactgaccgtcctaagttcagcccaaggctcgcccctcgtcactctgttcccaccctcctcacgtcgctaga

SEQ ID NO: 785346 - DNA, 526 bp, Homo sapiens
  misc_feature: HIJSMM301AU878.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggacaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcacctctcgttcccaccctcctcgtacg

SEQ ID NO: 785347 - DNA, 502 bp, Homo sapiens
  misc_feature: HIJSMM301AEHAU.52.47.E03.1.454.light.4.raw
cgcagtacgacacgaccggtgctcgatttagactcgcgcacagagagaagggggatcaggactcctcagttcaccttctcacaatgaggctccctgctcagctcctggggctgctaatgctctgggtcccaggatcaagtggggatgttgtgatgactcagtctccactctccctgcccgtcacccttggacagccggcctccatctcctgcaagtctagtgaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatggttggggtttattactgcatgcaaggtacacactggcctccgatcactttcggccgaggacacgactggagaattaaacgtaactagtggctgcacc

SEQ ID NO: 785348 - DNA, 508 bp, Homo sapiens
  misc_feature: HIJSMM301AWW5G.5.68.G02.1.454.light.4.raw
  modified_base (220)..(220): a, c, t, g, unknown or other
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagattttttanaagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcaagcccaaggctgccccctcggtcactctgttccccaccctcctcgtcgt

SEQ ID NO: 785349 - DNA, 488 bp, Homo sapiens
  misc_feature: HIJSMM301BWEBV.52.37.D04.1.454.light.4.raw
cgcagtacgacacgaccggtgctcgatttagtagcatactgttgggtttgggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcgaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctccg

SEQ ID NO: 785350 - DNA, 498 bp, Homo sapiens
  misc_feature: HIJSMM301BSNUB.27.78.H01.1.454.light.4.raw
  modified_base (468)..(468): a, c, t, g, unknown or other
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtacttactttacctcaagtgatcaccttcggaccaagggacacggactgganattaaacgaactgtggctgcaccatctgtt

SEQ ID NO: 785351 - DNA, 515 bp, Homo sapiens
  misc_feature: HIJSMM301AV39Y.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgaccgttcggccaagggacaaggtggaagtacaagacgaactgtggctgcaccgatctgtcttcatcttacccgccactc

SEQ ID NO: 785352 - DNA, 527 bp, Homo sapiens
  misc_feature: HIJSMM301B72KG.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtggttcgggcggagggaccaggctgacccgtcctaggtcagcccaaggctcgccccctcggtcactctcgttcccaccctt

SEQ ID NO: 785353 - DNA, 473 bp, Homo sapiens
  misc_feature: HIJSMM301ASTJW.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattccggcggaaggaccaagctgaccgtcctaggtcagcccaaggctgccccctcggtcactctgttcccgccctcctcgctacgtga

SEQ ID NO: 785354 - DNA, 493 bp, Homo sapiens
  misc_feature: HIJSMM301EZWMY.49.29.C07.1.454.light.4.raw
agtcgagagacacgaccggtgctcgatttagagtgctacgaagggaaagggggatcaggactcctcagttcacctcctcacaatgaggctccctgctcagctcctggggctgctaatgctctgggtctctggatccagtgggggtattgtgatgactcagtctccactctccctgcccgtcacccctggagagtcggcctccatctcctgcaggtctagtcagagcctcctatatagggatggatacaactatttggattggtacgtgcagaagccagggaagcctccacagctcctgatctatctggcttctaatcgggcctccggggtccctgacaggttcagcggcagtgtgtccggcacagattttacactaaaaatcagcagagtggaggctgacgatattggggtttattactgcatgcaagcaatacaccgcctcactttcggcggagggaccacactggagatacaaacgaactgtggctgcacc

SEQ ID NO: 785355 - DNA, 516 bp, Homo sapiens
  misc_feature: HIJSMM301E1A5R.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttggggcaaagctgccctgacactgtctggtgtgcagcctgaggacgaggctgactatactgcctactctactttggtggtgctgtgctattcggcggaggaccaagctgaccgtcttaagtcagcccaaggctcgccccctcggtcactctgttcccaccctccttaccg

SEQ ID NO: 785356 - DNA, 514 bp, Homo sapiens
  misc_feature: HIJSMM301ES03I.43.33.C11.1.454.light.4.raw
tgtgagtagtcacgaccggtgctcgatttagagtgagctcgttggggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtctacccttttttgccgggcgagtcggcccattgacgactgtttggcctggtatcgcgtgagaccagggcaacctcctcaacttctgatataccgttcatcgctgttgcacggttggggtccccacctcggttcagtggcaacggctctgagacagtatttttctctcgtcatcactggtctacagtctgacgacggcgcaatgtacttctgtcaacactatcgtccctcctcccccctactaactttcggtacgaggggacctaaggttagaacatacaatcgaacttggtggtctcgaccaccta

SEQ ID NO: 785357 - DNA, 465 bp, Homo sapiens
  misc_feature: HIJSMM301AXOJ3.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagtattttgcagttgtattactgtcagcagtatggtagctcacctcggacgttcggccaacgggaccgaacggtagg

SEQ ID NO: 785358 - DNA, 510 bp, Homo sapiens
  misc_feature: HIJSMM301B5FHQ.13.37.D04.1.454.light.4.raw
  modified_base (433)..(433): a, c, t, g, unknown or other
tcacgtactacacgaccggtgctcgatttagtagcatactgttgggtttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaagtaggcggccgtcagggatttccactcgcttctctggctccaagtctggcaacacggcctccctgacaatctctggtctccaggctgaggacgaggctgcctattactgctgctcatatgacnggttcttctgtggtcttcggcggaggtccaaagtcgaaccgtcctagtcagcccaaggctcgccccctcggtctacg

SEQ ID NO: 785359 - DNA, 516 bp, Homo sapiens
  misc_feature: HIJSMM301EL0G6.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttccggtccctgggaccgaaagtaggagtatcaaacgaaactgtggcgtgcaccactctgtcttcta

SEQ ID NO: 785360 - DNA, 484 bp, Homo sapiens
  misc_feature: HIJSMM301EADWR.17.26.C04.1.454.light.4.raw
cgtagactagcacgaccggtgctcgatttagtctagcgacttttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgtaagattttgcaacttactactgtcaacagagttacaatacccctcgctcactttcggcggaggacgaaggtggagatcaaacgaactagtggctgcacc

SEQ ID NO: 785361 - DNA, 510 bp, Homo sapiens
  misc_feature: HIJSMM301EJ902.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatcgcttcccagtccttctcacggggtcccctcgaggttcagtggcagtggatctgggacacatttcaccctcaccatcaatagcctggaagctgaagatgctgcaacttattactgtcatcagatacttactttacctacaagtgatcaccttcggaccaagggacacgactaggagaattaaaacg

SEQ ID NO: 785362 - DNA, 502 bp, Homo sapiens
  misc_feature: HIJSMM301EY3AZ.43.71.G05.1.454.light.4.raw
tgtgagtagtcacgaccggtgctcgatttagtgtcgtcgcaagagagaggggggaagagctgctcagttaggacccagagggaaccatggaaaccccagcgcagcttctcttcctcctgctactctggctccccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggaccaacgggacacgactggagattaaccgaactgtggctgcaccatctgtcttcta

SEQ ID NO: 785363 - DNA, 488 bp, Homo sapiens
  misc_feature: HIJSMM301EC9JU.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggcctaggggaccaagcgtggagatcaaacgaactgtggctgcaccat

SEQ ID NO: 785364 - DNA, 508 bp, Homo sapiens
  misc_feature: HIJSMM301BWUSD.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagcccaggttcagtggcagtgggtctgggacagagttcactctccaccatcagcagcctgcagtctgaagtattttgctagtttattactgtcagcagtataattactggcctcggacgttcgccgaacggaccaagggtacggaagtacaaacgaactacgtggccgtgcaccactctacgtcgttt

SEQ ID NO: 785365 - DNA, 512 bp, Homo sapiens
  misc_feature: HIJSMM301CRQ7S.40.34.D01.1.454.light.4.raw
tctagcgactcacgaccggtgctcgatttagatcgtctgtgttgggtttgggggtagctcaggaagcagagcctggagcatctccactatggcctgggctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccaccactttaatctatgaggataacaaaagactctctggggtccctgatcggttctctggctccatcgacagctcctccaattctgcctccctcaccatctctggactgaagactgaggacgaggcttgattagttactagtcagagttatgatgacaccaattactgggtgttcgggcggagggaccaaggctggaccgtcctaggtcagcccaaggctcgtccccctcggt

SEQ ID NO: 785366 - DNA, 510 bp, Homo sapiens
  misc_feature: HIJSMM301CMRXX.43.23.C01.1.454.light.4.raw
  modified_base (413)..(413): a, c, t, g, unknown or other
tgtgagtagtcacgaccggtgctcgatttagtacacgtgattagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagccccaaactcttgatttatgatgtcacttatcggccctcaggggtttcttatcgcttctctggctccaagtctggcaacacggcctccctgaccatctctgggctccaggctgaggacgaggctgattnttactgcaactcacttacaacgaccgacacttgcgtattcggcggcgggaccaaggctgaccgtctacggtcagcccaaggctgccccctcggtcac

SEQ ID NO: 785367 - DNA, 524 bp, Homo sapiens
  misc_feature: HIJSMM301AIVDS.41.87.H10.1.454.light.4.raw
tctatactatcacgaccggtgctcgatttagcagtactgcgttggggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccgggggtcgagggccggggatgaggccacctactattgtcacgtctgggagactggtgatgatcctgtggcgctattcggcggagggacgaagctgaccgtcgtgggtcagcccaaggctcgccccctcggtcactctcgttcccaccctcctc

SEQ ID NO: 785368 - DNA, 502 bp, Homo sapiens
  misc_feature: HIJSMM301DY4C8.40.31.C09.1.454.light.4.raw
  modified_base (488)..(488): a, c, t, g, unknown or other
tctagcgactcacgaccggtgctcgatttagacgtctcatcaaggaaggaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgctagtgtattactgtcagcagtatggtagctcaccgatcaccttcggccaagggacacgactggagattaaccgaactgtggctgcnccatctgtcttcta

SEQ ID NO: 785369 - DNA, 518 bp, Homo sapiens
  misc_feature: HIJSMM301B5CXK.26.80.H03.1.454.light.4.raw
  modified_base (457)..(457): a, c, t, g, unknown or other
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgtcggtccgaaggaccgaacgaagcgaatanaaacgaaactagtggcgtgtcaccactactcgtcttacctatcttcccgtcccactctacg

SEQ ID NO: 785370 - DNA, 518 bp, Homo sapiens
  misc_feature: HIJSMM301CI644.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgacccatctctgggctccaggctgatgacgaggctgattattactgcagggttcatatacaatcagccaaacactttatgttccttcgggactgggaccaagactcaccgtcctaggtcgagcccaaaggcccaacccccactgtccta

SEQ ID NO: 785371 - DNA, 509 bp, Homo sapiens
  misc_feature: HIJSMM301CLM17.5.86.H09.1.454.light.4.raw
  modified_base (431)..(431): a, c, t, g, unknown or other
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctctatttgcnggcagccgtatactcttcggcggaggaccaagctgaccgtctaggtcagcccaaggcctcgcccccgtcggtcctacc

SEQ ID NO: 785372 - DNA, 442 bp, Homo sapiens
  misc_feature: HIJSMM301CLCC2.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggacggcgggaccaagttgaccgtcctacgtcagccaagctgcccctcggtcactctgttcccgccctcctcgacacgcgag

SEQ ID NO: 785373 - DNA, 511 bp, Homo sapiens
  misc_feature: HIJSMM301A7SOL.49.82.H05.1.454.light.4.raw
agtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggcgtggggacgaggctgattattattgctgttcatatgccggtgatagtggccgaaggggtgttcgggcggagggaccgaaggtgaccgtcctaggtcacgcccgaaggcctcgccccctcggt

SEQ ID NO: 785374 - DNA, 493 bp, Homo sapiens
  misc_feature: HIJSMM301ASD82.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaaatagcctggaagctgaagatgctgcaacttattactgtcatcagagtactactttacctcaagtgatcaccttcggccaagggcacgactggagattaaacgaactgtggctgcacatctgtctt

SEQ ID NO: 785375 - DNA, 504 bp, Homo sapiens
  misc_feature: HIJSMM301D8CUL.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagaccgttcggccaaagggtaccaagggtggaaattcaaaacgaactgtggctgcacctaa

SEQ ID NO: 785376 - DNA, 487 bp, Homo sapiens
  misc_feature: HIJSMM301A53WR.15.1.A01.1.454.light.4.raw
  modified_base (486)..(486): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctcaagtctggcaacacggcctccctgacaatctctgggctccaggctgacgacgaggctaattattactgctgctcatatgaaggttataaacactatactattcggcggagggaccaagctgaccgttcctgcgtcagcccaaggctcgccccctggtccactctcttcccgccctcctcgctacgtana

SEQ ID NO: 785377 - DNA, 506 bp, Homo sapiens
  misc_feature: HIJSMM301ELL60.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggcctgggaccaaggtggagatcaaacgaactgtggctgcaccatctgtcttcta

SEQ ID NO: 785378 - DNA, 498 bp, Homo sapiens
  misc_feature: HIJSMM301AZPO0.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtctgcagtataataactggcctccacggtacacttttggccaggggaccaagctggaggatcaaacgaactgtggctgcaccatctgtt

SEQ ID NO: 785379 - DNA, 493 bp, Homo sapiens
  misc_feature: HIJSMM301BR6WP.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatccttcccgccta

SEQ ID NO: 785380 - DNA, 495 bp, Homo sapiens
  misc_feature: HIJSMM301EMIQJ.43.34.D01.1.454.light.4.raw
tgtgagtagtcacgaccggtgctcgatttagatcgtctgtgttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgacgttggttattataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattattgcagttcatatacaagcagcaccactattatgtcttcggagctgggaccaggtcaccgtcaggtcagcccaaggccaa

SEQ ID NO: 785381 - DNA, 505 bp, Homo sapiens
  misc_feature: HIJSMM301BLJ2F.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccagacaaagccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggaggaccaagctgaccgtcctaggtcagcccaaggctgccccctcggt

SEQ ID NO: 785382 - DNA, 502 bp, Homo sapiens
  misc_feature: HIJSMM301AQZHV.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattacttgtcagcagtataataactcggcctccacggtactacttttggcctaggggaccaagctggagagtcaaacgaactgtggctgcaccatctgtt

SEQ ID NO: 785383 - DNA, 519 bp, Homo sapiens
  misc_feature: HIJSMM301CGS14.43.59.F04.1.454.light.4.raw
  modified_base (423)..(423): a, c, t, g, unknown or other
  modified_base (440)..(440): a, c, t, g, unknown or other
tgtgagtagtcacgaccggtgctcgatttagtacacacacttagggattggggctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggcccccacggcactgatttatggtgcgactaacaaacactcctggacccctgcccggttttcaggctccctcctcgggggcaaagctgccctgacactgtcaggtgtgcagcctgaggacgaggctgactattactgcctgctcatntatggtggcgcgtgggngttcggcggagggaccaagcgtgaccgtccgtgggtcacgcccaaggctcgccccctcggtcactctcgttcccaccct

SEQ ID NO: 785384 - DNA, 498 bp, Homo sapiens
  misc_feature: HIJSMM301EOARO.41.16.B05.1.454.light.4.raw
tctatactatcacgaccggtgctcgatttagagctcacgtaaggggggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtacacttttggccaggggaccaagctcgagatacaaacgaactgtggctgcaccatctgtcttcatccttcccg

SEQ ID NO: 785385 - DNA, 502 bp, Homo sapiens
  misc_feature: HIJSMM301CAYKE.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggctagtttattattgtcagcaatattatattcctcctcagtaccgttcggccaagggaccgaaggtggaaatcaaacgaactgtggctgcaccta

SEQ ID NO: 785386 - DNA, 512 bp, Homo sapiens
  misc_feature: HIJSMM301EJ2BB.26.26.C04.1.454.light.4.raw
agactatactcacgaccggtgctcgatttagtctagcgacttttggggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgtcggtttattactgcctgcagagtattcactggccgtgggaacgttcgggccgtaacgggaccgaagggtaggaaatcaaacgaactcgtggctggcacc

SEQ ID NO: 785387 - DNA, 514 bp, Homo sapiens
  misc_feature: HIJSMM301DM6DH.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggacgggaccaggtctggacccgttcgttaggtcacgcccgaaggcctcggcccccgtcggtccacctcgtcgtttccccccg

SEQ ID NO: 785388 - DNA, 504 bp, Homo sapiens
  misc_feature: HIJSMM301AW1GV.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctacgagcctgaagtattttgctacttttattactgtcagcagcgtagacaactcggtcctctctactttcggcgggtagggaccgaggggtcggagagtcagaacgaacgtggt

SEQ ID NO: 785389 - DNA, 511 bp, Homo sapiens
  misc_feature: HIJSMM301BNAJJ.43.23.C01.1.454.light.4.raw
tgtgagtagtcacgaccggtgctcgatttagtacacgtgattagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgacaatctctgggctccaggctgaggacgaggctgattattattgctgctcatatgcaggtagttactacttatgtcttcggaattgggacgacggtcaccgtcctaggtcagcccaacggcccaaccccactgta

SEQ ID NO: 785390 - DNA, 505 bp, Homo sapiens
  misc_feature: HIJSMM301DM5DD.4.39.D06.1.454.light.4.raw
agcactgtagcacgaccggtgctcgatttagtgacatctcgcagttctttggggggagtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctcctgaccgtctctgggctccaggctgaggatgaggctgattattattgcagctcatatgcaggcagttacaatgtgatattcggcggagggaccaaactgaccgtcctaaggtccagcccaaggctcgtccccccg

SEQ ID NO: 785391 - DNA, 498 bp, Homo sapiens
  misc_feature: HIJSMM301BL6AC.43.61.F06.1.454.light.4.raw
tgtgagtagtcacgaccggtgctcgatttagctacgctctaagggaaagggggaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtactacttttggccaggggaccaagctagaaatacaaacgaactagtggctgcaccatctgtctt

SEQ ID NO: 785392 - DNA, 496 bp, Homo sapiens
  misc_feature: HIJSMM301AN2OT.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttattactgtcagcaatattatagtactcctccgaggctcactttcggcggacgggaccgaagggtggagatacaaacgaa

SEQ ID NO: 785393 - DNA, 496 bp, Homo sapiens
  misc_feature: HIJSMM301BU112.41.53.E09.1.454.light.4.raw
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcgaggggtttctaatcgcttctctggctccaagtctggcaacacggcctccctgaccatctctgggctccaggctgaggacgaggctgattattactgcagctcatatacaagcagcagcactctcgtggtattcggcggagggacaagctgaccgtcctaggtcagcccaa

SEQ ID NO: 785394 - DNA, 521 bp, Homo sapiens
  misc_feature: HIJSMM301D0CAV.40.47.E03.1.454.light.4.raw
tctagcgactcacgaccggtgctcgatttagactcgcgcacagagagaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtggttcgggcggggggtaccaagctgaccgtcctaggtcagcccaaggcctcgccccctcggtccactcttccg

SEQ ID NO: 785395 - DNA, 513 bp, Homo sapiens
  misc_feature: HIJSMM301AE27W.47.85.H08.1.454.light.4.raw
agctcacgtacacgaccggtgctcgatttagtatcactcagtcgcgggggggggtctcaggaggcagcgctctcaggacatctccaccatggcctgggctctgctgctcctcaccctcctcactcaggtcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgttcgtttgggtgttcggcggagggaccaagttcgaccgtcctaggtcagcccaaggctcgccccctcggtcactctgtt

SEQ ID NO: 785396 - DNA, 490 bp, Homo sapiens
  misc_feature: HIJSMM301AS21A.11.25.C03.1.454.light.4.raw
  modified_base (463)..(463): a, c, t, g, unknown or other
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctggactattattgtcaggcgtgggacagcagcactgccggtatgtcttcggaactgggaccaaggtcnccgtaaacttgagtcagccaaggccaa

SEQ ID NO: 785397 - DNA, 503 bp, Homo sapiens
  misc_feature: HIJSMM301BNVJK.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattaatagtactcctccgaggctcactttcggacggtagggaccgtaacggtggaagatacaaacgaaactt

SEQ ID NO: 785398 - DNA, 504 bp, Homo sapiens
  misc_feature: HIJSMM301EB6MG.2.35.D02.1.454.light.4.raw
  modified_base (372)..(372): a, c, t, g, unknown or other
  modified_base (427)..(427): a, c, t, g, unknown or other
  modified_base (469)..(469): a, c, t, g, unknown or other
  modified_base (498)..(498): a, c, t, g, unknown or other
acgctcgacacacgaccggtgctcgatttagcacacgatagttggggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaggcagcagtgacgttggcggttataactatgtctcctggtatcaacaacaccccggcgaagcccccaaactcctcatttatgaggtcactaagcggcccttaggggtccctgatccgcttctctggctccaagtctggcagaacggcctcccngtaccgtctctgggctccaagctgaggatgaggctgattattactgcagctcatntgcaggcagcagcaatgtattttcggcggagggaccaagctnacgtcctgggtcagccaaggctgcccccngtctac

SEQ ID NO: 785399 - DNA, 504 bp, Homo sapiens
  misc_feature: HIJSMM301DJT9N.4.59.F04.1.454.light.4.raw
agcactgtagcacgaccggtgctcgatttagtacacacacttagggattgggcacgaccggtgctcgatttagtacacacacttagggattggggaggaactgctcagttaggacccagacggaaccatggaagccccagcgcagcttctcttcctcctgctactctggctcccagataccactggagaaataatattgacgcagtctccagccaccctgtctgtgtctccaggggaaagagcccaccctctcctgccagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgctagtttattattgtcaccagtattatagttggcctccgtggacgtcggcgaacggacgacgtaa

SEQ ID NO: 785400 - DNA, 509 bp, Homo sapiens
  misc_feature: HIJSMM301A2JMU.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctcgttccca

SEQ ID NO: 785401 - DNA, 481 bp, Homo sapiens
  misc_feature: HIJSMM301EQEFN.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaaggacacgactggagataacgaactgtgctgcaccat

SEQ ID NO: 785402 - DNA, 507 bp, Homo sapiens
  misc_feature: HIJSMM301CHPJ8.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagcgggatgaggccgactattactgtcaggtgtgggatagtagtggtgatcatccatacgtcttcggaactggaccaaggtctccgtcctacgtcacgcccaaggccaacgtccactcgtacactcg

SEQ ID NO: 785403 - DNA, 500 bp, Homo sapiens
  misc_feature: HIJSMM301EYPG8.5.24.C02.1.454.light.4.raw
atcagacacgcacgaccggtgctcgatttagtacagatcgttagggaaagggggctgggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaacgcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatcgtgagtcgttcgggcggggggaccgaagctcgaccgtcctaggtca

SEQ ID NO: 785404 - DNA, 486 bp, Homo sapiens
  misc_feature: HIJSMM301A9HQY.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcgccctcaggggtttctaatcgcttctctggctccaagtctggcaacacggcctccctgaccatctctgggctccaggctgaggacgaggctgattattactgcagctcatatacaagcagcagcactcaagtcttacggaactgggaccaaggtccaccgtcctaggtc

SEQ ID NO: 785405 - DNA, 497 bp, Homo sapiens
  misc_feature: HIJSMM301EYRR0.7.71.G05.1.454.light.4.raw
cgtgtctctacacgaccggtgctcgatttagtgtcgtcgcaagagagaggggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgttcaacatcgtaccgagtggcctccgggggccacctttccggccctcgggaccaaaggtggatatacaaacgtacgtagt

SEQ ID NO: 785406 - DNA, 464 bp, Homo sapiens
  misc_feature: HIJSMM301CJL1Y.11.73.G07.1.454.light.4.raw
  modified_base (450)..(450): a, c, t, g, unknown or other
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatcgtgggacagactttactctcaccatcagcagcctgcagcctgaagtatattgacaactatattactgtcaacagtatgatcgtctctcaatttcggccctgggaccagngtgacatgaacgaa

SEQ ID NO: 785407 - DNA, 507 bp, Homo sapiens
  misc_feature: HIJSMM301E1LBH.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactggggaccaaggtcaccgtcctaggtcagcccaaggccaaccccactgtcact

SEQ ID NO: 785408 - DNA, 510 bp, Homo sapiens
  misc_feature: HIJSMM301ELXNV.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctggagcgattctctggctccaggtcagggacaacggtcacattggtcatcagtggagtccaggcagaggacgaggctgactattattgtcaatcaacagacaccacttggtacttatgtcttcggaactgcgaacaacggtcaccgtcctcgggtctacgcccaacggcccaacccccacctgtccactccttccg

SEQ ID NO: 785409 - DNA, 497 bp, Homo sapiens
  misc_feature: HIJSMM301CR0T2.5.14.B03.1.454.light.4.raw
atcagacacgcacgaccggtgctcgatttagtgtgagtagttccgcgggggagtcagacccagtcaggacacagcatggacatgagggtccccgctcagctcctggggctcctgctgctctggttcccaggttccagatgcgacatccagatgatccagtctccttctttcgtttctgcatctgtaggagacagacttactctcacttggtcgggcgagtcacgatattagtaccaggttagcctggtatcagcagaagccagggaaagcccctaaactcctgatctatgctgcatccagtttgcaaagtggggtcccatcgaggttcagcggcagttggatctgggacagatttcactctcaccatcagcaggctgcagccgaagattttgctaacttactattgtcaaaatactaacacgtctcccgcgcagttttggaccaggggaaccaaagtggagatacaaacgaactagtggctagcaccatctcgtctt

SEQ ID NO: 785410 - DNA, 508 bp, Homo sapiens
  misc_feature: HIJSMM301BOZLO.53.8.A08.1.454.light.4.raw
cgcgtatacacacgaccggtgctcgatttagcatactctacagggggtgggtccaggaggcagaactctgggtgtctcaccatggcctggatccctctacttctccccctcctcactctctgcacaggctctgaggcctcccatgagttgatacagccatcctcggtgtcagtgtccccaggacagacggccacgattatttgctctggagatgcattggcaaagcaatttgcttcttggttccagcagaagccaggccaagcccctgtactggtgatttataaaggctctgagacggcccccagggatccctgagcgattctctgggtccgactcagggacaacagccatgttgaccatcagtggagtccaggcagaagacgaggctgactattattgtcagtacagcagacaacactgttgtttctgtgtttttacggcggagggaccaggctcggaccgtcctgggtcacgacccaaggctcgcccccgtcggtctactctcgtt

SEQ ID NO: 785411 - DNA, 473 bp, Homo sapiens
  misc_feature: HIJSMM301DSAMV.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgatttgcaacttctactgtcaacagagttccactaccccaatcactttcggcctgggactgaagtgcatatgaagagaactgtggctgca

SEQ ID NO: 785412 - DNA, 511 bp, Homo sapiens
  misc_feature: HIJSMM301AWR2I.22.21.B10.1.454.light.4.raw
acatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggcctccaggctgaggatgaggctgattattactgctactcatatgcaggcggcaactcttgggtgttcgggcggagggaccaagctgaccgtcctaggtcacgccaaggctcgccccctcggtcactcttccg

SEQ ID NO: 785413 - DNA, 514 bp, Homo sapiens
  misc_feature: HIJSMM301CPKWH.11.67.G01.1.454.light.4.raw
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctggtggtcttcgggcggagggaccaagctgaccgtcctgggtcagcccgaaggcctcggccccctcggtcacttcg

SEQ ID NO: 785414 - DNA, 464 bp, Homo sapiens
  misc_feature: HIJSMM301DORLG.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtgggtttttcggcgggagggaccaaggctgaccgtcctaggtcagcccaaggctgccccctcggtcactctgttcccaccctcctcgtatctctcg

SEQ ID NO: 785415 - DNA, 505 bp, Homo sapiens
  misc_feature: HIJSMM301AMZW8.13.38.D05.1.454.light.4.raw
tcacgtactacacgaccggtgctcgatttagtatctgatagttgggtttgggggcaggagtcagacccagtcaggacacagcatggacatgagggtccccgctcagctcctggggctcctgctgctctggctcccaagtgccaaatgtgacatccagatgacccagtctccttccaccctgtctgcgtctgtgggagacagagtcattatcacttgccgggccactcagtttgttggtaggtggttgtcctggtatcagcaaaagccagggcaagcccctaaactcctgatctttgaggcgtctactttagaacgggggatctcacccaggttcagcggcagtggatctgggacagaattcaccctcaccatcaacagcctgcagcctgaagactctgcaacttactactgtacaacagtataatacttattactacttttggccgagggaccaaagtggagatacaaacgaactgtggctgcaccatctgtcttcatcttcccg

SEQ ID NO: 785416 - DNA, 522 bp, Homo sapiens
  misc_feature: HIJSMM301ENTAP.3.33.C11.1.454.light.4.raw
agacgcactccacgaccggtgctcgatttagagtgagctcgttgggtttggggggggtctcaggaggcagcgctctcgggacgtctccaccatggcctgggaactctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccaagattaatgatttatgatgtcagtgatcggccctcaggggtttctcatcgcttttctggctccaagtctggcaacacgcctccctgaccatctctgggctccaggctgaggacgaggctgattatttctgcagctcatacacaaccggcaccactgtcgtggttttcggtggagggaccaagctgaccgtcctaggtcagcccaaggctcgccccctcggtcactcc

SEQ ID NO: 785417 - DNA, 511 bp, Homo sapiens
  misc_feature: HIJSMM301AMLOC.11.57.F02.1.454.light.4.raw
cgagagataccacgaccggtgctcgatttagctcgatatagttgggtttgggggaggaactgctcagttaggacccagaggggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagatttgcagtttattactgtcaacagcgtagcagcaggcctccggcgacgttcggccaagggaccgaaggtggaagtcaagacgaacgtgtggctgcgaccatctgtcttctactcttccg

SEQ ID NO: 785418 - DNA, 342 bp, Homo sapiens
  misc_feature: HIJSMM301A5TI6.47.64.F09.1.454.light.4.raw
agctcacgtacacgaccggtgctcgatttagcgcgtatacaaggggggaggaactgctcagttaggacccagagggaaccatggaagccccagctcagcttctcttcctcctgctactctggctcccagataccatcggagaagttgtgttgacacagtctccagccaccctgtctttgtctccaggggaaagacctaccctctcctgcagggccagtcagaatattcactcctacttagcctggtaccaactacgaaaccgtggtcgaggcctcccaggctcctctatctatgatgcataccaacgacgggccactcggcactcccagacaggttcagtgg

SEQ ID NO: 785419 - DNA, 539 bp, Homo sapiens
  misc_feature: HIJSMM301ED1Q0.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacggaggctgtattattactgctgctcatatacagggggacagctaatttattttggggttcggtttcgggccgggaggggaccaaagcctggacccgtccgtgccgtcacgcccaacggctcgccccctccggtccactt

SEQ ID NO: 785420 - DNA, 523 bp, Homo sapiens
  misc_feature: HIJSMM301B1WRB.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgattcgttcgggtcggggggaccgaagcgtgacccgtccgttaggtcctacgcccaagggctcgtcccccccg

SEQ ID NO: 785421 - DNA, 515 bp, Homo sapiens
  misc_feature: HIJSMM301BQPOH.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgctaggtcgttatctctttatgttcttcggaactgggaccctaaaggtccaccgtcctaggtcacgcccaacggcccaaccccactgtcta

SEQ ID NO: 785422 - DNA, 511 bp, Homo sapiens
  misc_feature: HIJSMM301D0K0G.3.79.H02.1.454.light.4.raw
agacgcactccacgaccggtgctcgatttagtgtcacacgaagggaaagggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcgatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcaggcccaaggctgaccccctcggt

SEQ ID NO: 785423 - DNA, 506 bp, Homo sapiens
  misc_feature: HIJSMM301DPKDJ.4.57.F02.1.454.light.4.raw
  modified_base (439)..(439): a, c, t, g, unknown or other
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggcccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggcaccctgaccatcagcagggtcgaagccggggatgaggccgactagttactgtcaggtgtgggatagtagtggtgatcatccatacgtnttcggaactgggaccaagtctccgtcctacgtcagcccaaggccaacccactgtcactctgttccca

SEQ ID NO: 785424 - DNA, 511 bp, Homo sapiens
  misc_feature: HIJSMM301BRZ6Q.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcaggtgggtctggggcaggacttcactctcaccatcagcagcctagagcctgaagattttgcagttttattactgtcagcagcgtagcaactggcctcggttctacgttttggccaggggaccaagcgtggagtatacaaacgaactggtggctgcaccatctgtcttcattccc

SEQ ID NO: 785425 - DNA, 507 bp, Homo sapiens
  misc_feature: HIJSMM301CIUKA.5.86.H09.1.454.light.4.raw
atcagacacgcacgaccggtgctcgatttagtgctatagacttggggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgccgtcctaggtcagcccaaggctcgccccctcggtccta

SEQ ID NO: 785426 - DNA, 530 bp, Homo sapiens
  misc_feature: HIJSMM301AZLQH.48.70.G04.1.454.light.4.raw
agtatacatacacgaccggtgctcgatttagtgtagtgtgaagggaaagggggggggagcctagctgtgctgtgggtccaggaggcagaactctgggtgtctcaccatggcctgggtccccctacttctccccctcctcactctctgcacaggctctcaggcctcctatgagttgacacagccaccctcggtgtcagtgtcccccaggacagacggccaggatcacctgctctggagatggattgccaacacaatatgcgtactggtaccagaagaagccaggccaggcccctgttttggtgatatatcaagacactcagagggcctcagggacccctgagcggttctctggctccagctcaggggcaacagtcgcgttgacaatcagggaagtccaggcagaggacgaggctgactattactgtcagtctgcagacaacggaggtacttacttggtcttcggcggagggaccaaggttgaacgttccgtgggtcacggcccaaggcctcggccccccgtcggtcctacc

SEQ ID NO: 785427 - DNA, 509 bp, Homo sapiens
  misc_feature: HIJSMM301BMA53.43.34.D01.1.454.light.4.raw
tgtgagtagtcacgaccggtgctcgatttagatcgtctgtgttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcgggaattgggacgacggtcctaccgtcctaggtcagccccaaggcccaacccctacg

SEQ ID NO: 785428 - DNA, 501 bp, Homo sapiens
  misc_feature: HIJSMM301ASE92.9.1.A01.1.454.light.4.raw
tgatacgtctcacgaccggtgctcgatttagacgtctcatcaggggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtacaaacaccttcggaccgaagggacacgactggagaattaaaggaactagtggctgcacatctgtcttcatcttaccccg

SEQ ID NO: 785429 - DNA, 488 bp, Homo sapiens
  misc_feature: HIJSMM301APWQY.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagaccaggttcagtggcagtgggtctgggacagacttcactctcaccatcagcagactggacgcctgaggattttgcagtgtattactgtcagcagtatcataggtacaaacaccttcggccgaagggacacgactggagattaaagaactagtggctgcaccatctgtcttc

SEQ ID NO: 785430 - DNA, 505 bp, Homo sapiens
  misc_feature: HIJSMM301CEEIZ.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacaccggcctccctgaccgtctctgggctccagcctgaggatgaggctgattattactgcagctcatatgcaggcatcaacactgttttcggcgggagggaccaagctcgaccgtacctaggtcagcccaacggctcgtccccccg

SEQ ID NO: 785431 - DNA, 504 bp, Homo sapiens
  misc_feature: HIJSMM301CZXSW.18.59.F04.1.454.light.4.raw
tacgagtatgcacgaccggtgctcgatttagtacacacacttagggattgggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttcaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaacccc

SEQ ID NO: 785432 - DNA, 527 bp, Homo sapiens
  misc_feature: HIJSMM301ARHMS.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggccccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtcttatcggttggttcggtcggggggaccggaacggcgtgaccggtcccgtacggtccgtagcccgaacggacgtcgcccccgtcccggtccacgtcttcc

SEQ ID NO: 785433 - DNA, 497 bp, Homo sapiens
  misc_feature: HIJSMM301AXZ7L.13.76.G10.1.454.light.4.raw
tcacgtactacacgaccggtgctcgatttagtcactcatacaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacggggcccaggcagaagatgaatctgattattactgtgttctttatatgggtagtgccatttctgctgtgttcggaggaggcacccggctgaccgtcctcggtcagcccaaggctgcccatc

SEQ ID NO: 785434 - DNA, 504 bp, Homo sapiens
  misc_feature: HIJSMM301ARM8B.48.27.C05.1.454.light.4.raw
agtatacatacacgaccggtgctcgatttagacgcgatcgaagggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccagactgaccgtcctaggtcagcccaaggctcgccccccg

SEQ ID NO: 785435 - DNA, 507 bp, Homo sapiens
  misc_feature: HIJSMM301AS8LF.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggccgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtacaacgaactagtggctgcaccatctcgtcttcatcc

SEQ ID NO: 785436 - DNA, 502 bp, Homo sapiens
  misc_feature: HIJSMM301E4DY7.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttctatccttccccg

SEQ ID NO: 785437 - DNA, 463 bp, Homo sapiens
  misc_feature: HIJSMM301APWP6.9.1.A01.1.454.light.4.raw
tgatacgtctcacgaccggtgctcgatttagacgtctcatcaggggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccaggcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtcaaacacctcgccaaggacacgactgagattaaaggaactg

SEQ ID NO: 785438 - DNA, 445 bp, Homo sapiens; identical to SEQ ID NO: 742496
  misc_feature: HIJSMM301ATJLQ.11.3.A03.1.454.light.4.raw

SEQ ID NO: 785439 - DNA, 500 bp, Homo sapiens
  misc_feature: HIJSMM301BQDW9.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggtacttttggccgaggggaccaagctggagatacaaacgaactagtggctgcaccatctgttctt

SEQ ID NO: 785440 - DNA, 498 bp, Homo sapiens
  misc_feature: HIJSMM301AIGMK.3.10.A10.1.454.light.4.raw
  modified_base (446)..(446): a, c, t, g, unknown or other
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatataataaagacagtgagaggccctcagggatccctgagcgattctctggctccagctcagggacaacagtcacgttgaccatcagtggagtccaggcagaggacgaggctgactattattgtcaatcagcagacaacaagtaattacttatctttattgtcttcgtancgtgggaccagggtccaccgtcctacggtcacgcccaacggacccaacccca

SEQ ID NO: 785441 - DNA, 449 bp, Homo sapiens
  misc_feature: HIJSMM301A31B2.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcgggcctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccaccctcctccatacctcgta

SEQ ID NO: 785442 - DNA, 479 bp, Homo sapiens
  misc_feature: HIJSMM301BB4HN.13.76.G10.1.454.light.4.raw
  modified_base (420)..(420): a, c, t, g, unknown or other
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgtaggctgactatactcgtcaggacgtggacgagcancgactcgcccgcgtatgtccttcggaacgtcgggtaccaaggtacacgtaccctaagtt

SEQ ID NO: 785443 - DNA, 485 bp, Homo sapiens
  misc_feature: HIJSMM301DV8E0.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccacgggccactggtatcccagccaggttcagtggcagtgggtctgggacagagttcactctcaccatcagcagcctgcagtctgaagattgtgctaatttattactgtcagcaatataatacctggcctccgctcactttcggcggaggaccaaggtgaagatcaaacgaactgtggctgc

SEQ ID NO: 785444 - DNA, 497 bp, Homo sapiens
  misc_feature: HIJSMM301AGC7N.17.34.D01.1.454.light.4.raw
  modified_base (428)..(428): a, c, t, g, unknown or other
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtgcagcgggtcagggacagattttacactagaaaatcagccgggtggaggctgaggacgttggaatttattactgtangcaaggtatagagcttcctccgacgttcggccaacgggaccaaggtggaactcaaacgaacagtggctg

SEQ ID NO: 785445 - DNA, 509 bp, Homo sapiens
  misc_feature: HIJSMM301EMFQH.8.33.C11.1.454.light.4.raw
ctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccacgtttcggccctgggaccaaggtggagatcaaacgaactgtggctgcaccatctgtcttcta

SEQ ID NO: 785446 - DNA, 368 bp, Homo sapiens
  misc_feature: HIJSMM301DW9SP.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattca

SEQ ID NO: 785447 - DNA, 514 bp, Homo sapiens
  misc_feature: HIJSMM301CGS04.15.59.F04.1.454.light.4.raw
  modified_base (439)..(439): a, c, t, g, unknown or other
tctacgtagccacgaccggtgctcgatttagtacacacacttagggagttggggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaagctgccctcaccatcacgggggcccaggcagatgatgaatctagtttattattgtgtcctatatatgggtnctggcatttcggtcttcggcgggtagggaccaaggctgaccgtcctaggtcacgtcccaaggctcgccccctggt

SEQ ID NO: 785448 - DNA, 503 bp, Homo sapiens
  misc_feature: HIJSMM301BVPVC.22.38.D05.1.454.light.4.raw
  modified_base (465)..(465): a, c, t, g, unknown or other
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggccaggggaccaagctggagntacaacgaactgtggctgcaccatctgtcttcattccg

SEQ ID NO: 785449 - DNA, 530 bp, Homo sapiens
  misc_feature: HIJSMM301DOKGS.7.34.D01.1.454.light.4.raw
cgtgtctctacacgaccggtgctcgatttagatcgtctgtgttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacgaggggacaggctagttagtttggggtgttcggcgggagggaccaagctgaccgtcctgcgtcgacgcccaaggcctcggccccctcggtactacttccg

SEQ ID NO: 785450 - DNA, 518 bp, Homo sapiens
  misc_feature: HIJSMM301A57KS.5.58.F03.1.454.light.4.raw
atcagacacgcacgaccggtgctcgatttagtctgatcgagaaggggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagccccctaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcactaccttttatgttcgggactgggaccaaggtcaccgtcctaggtcagcccaacggccaaccccactgtcactctccg

SEQ ID NO: 785451 - DNA, 513 bp, Homo sapiens
  misc_feature: HIJSMM301C3VV3.47.85.H08.1.454.light.4.raw
  modified_base (415)..(415): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttnctcttgggcaactactgtcgttgggtgttcggcggagggaccaagtcgaccgtctaggtcagccaaggcctgccccctcggtccactctcgttccccg

SEQ ID NO: 785452 - DNA, 495 bp, Homo sapiens
  misc_feature: HIJSMM301COBB2.47.70.G04.1.454.light.4.raw
  modified_base (412)..(412): a, c, t, g, unknown or other
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaanagagttacggtaccccgtacacttttggccgacgggaccaactaggacatacaaacgaaacctgtggtctgacaccatctgtt

SEQ ID NO: 785453 - DNA, 474 bp, Homo sapiens
  misc_feature: HIJSMM301AY1NF.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattaattgcagttcatatgtagtatgaagactcttgtgattttcggcggagggaccaagctgaccgt

SEQ ID NO: 785454 - DNA, 492 bp, Homo sapiens
  misc_feature: HIJSMM301B55XM.19.14.B03.1.454.light.4.raw
tactctcgtgcacgaccggtgctcgatttagtgtgagtagttccgcgggggggggtctcaggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatggttggtggttataactatgtctcctggtaccaacaacacccagcaaggcccccaaagtcatgatttatgatgtcagtgagcggccctcagggtccctgatcgcttctctggctccaagtctggcaacacggcctccctaaccatctctgggctccaggctgaggatgaggctgattattactgctgctcatatgcaggcaggtactacgtttggtattcgggcggagggaccaagctgaccgtcctaggtcacgcccaagg

SEQ ID NO: 785455 - DNA, 502 bp, Homo sapiens
  misc_feature: HIJSMM301AVVG5.48.73.G07.1.454.light.4.raw
agtatacatacacgaccggtgctcgatttagctctacgctcagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatgtagctcaccgatcaccttcggcccaagggacacgactggagattaaccgaactagtggctgcaccatcttgtcttcatcttccccg

SEQ ID NO: 785456 - DNA, 496 bp, Homo sapiens
  misc_feature: HIJSMM301D7WGH.41.8.A08.1.454.light.4.raw
tctatactatcacgaccggtgctcgatttagcatactctacagggcacgaccggtgctcgatttagcatactctacagggggggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagtctttttagcctggtatcagcagagaccagggaaacgcccctaaactcctgatctatgctgcatccagtttgacaaaggtggggtcccatcaaggttcagcggcagtggatcgtgggacagatttcactctcaccatcagcagcctgcagcctgacgtattttcgctaacttacttattgtacaacaggactaacagtttcccgatcgaccgtcggaccgaaggacaacg

SEQ ID NO: 785457 - DNA, 514 bp, Homo sapiens
  misc_feature: HIJSMM301ASP4H.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactaattactgtcaggtgtgggacagtaatagtgatcccgagcaggttttcggcggtgggaccaagctgaccgtcctaagtcagccaaggctgccccctcggtcactctgttccccg

SEQ ID NO: 785458 - DNA, 511 bp, Homo sapiens
  misc_feature: HIJSMM301AQRQ8.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagccggccctcaggggtttctgatcgcttctctggctccaagtctggcaatacggcctccctgacagtctctcggctccaggcggaggacgaggctgattactactgcttctcatatgcagatacttaagtcctgggtggttcggcggagggaccaagctgccgtcctaggtcacgcccaacggctcgccccctcggtcc

SEQ ID NO: 785459 - DNA, 506 bp, Homo sapiens
  misc_feature: HIJSMM301AG9RA.5.86.H09.1.454.light.4.raw
atcagacacgcacgaccggtgctcgatttagtgctatagacttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccagctgaccgtcctaggtcagcccaaggctcgccccctcggtccta

SEQ ID NO: 785460 - DNA, 530 bp, Homo sapiens
  misc_feature: HIJSMM301AJDX5.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctagaagatgtggctagtttattattgtcaaacaattattattaattacgtttcgtgggtacgttcggtccgaacggggacccgaagggtacgggaagtaattaccgaaggtaaccgaaccgtaggttggg

SEQ ID NO: 785461 - DNA, 496 bp, Homo sapiens
  misc_feature: HIJSMM301BSNIE.19.71.G05.1.454.light.4.raw
  modified_base (356)..(356): a, c, t, g, unknown or other
  modified_base (409)..(409): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagngggtctgggacagatttcactctcaccatcagcagcctgcaggctgaagatgnggcagtttattattgtcaacaattattattataacttcgtgggtaccgttcggtccaagggaccaaggtgggaatatctagaacgaa

SEQ ID NO: 785462 - DNA, 498 bp, Homo sapiens
  misc_feature: HIJSMM301C130C.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgcaacgcagggatattactcatctctgggctccagtctgacgatgaggctgactattactgtttgacttggcacaacaacgcctggatcttcggacctgggaccacggtccaccgtcctaggtcagcccaaggccaaccccactgtcactct

SEQ ID NO: 785463 - DNA, 478 bp, Homo sapiens
  misc_feature: HIJSMM301CXC9E.16.86.H09.1.454.light.4.raw
  modified_base (356)..(356): a, c, t, g, unknown or other
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgnatctcatatacaaccaacagcactctcgactggtattcggcggagggaccaagctgaccgtcctagtcagcccaaggctgccccctcggtcactctgttcccgcctccctcgactaggtaca

SEQ ID NO: 785464 - DNA, 520 bp, Homo sapiens
  misc_feature: HIJSMM301B4WAQ.17.33.C11.1.454.light.4.raw
cgtagactagcacgaccggtgctcgatttagagtgagctcgttgggtttgggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcggacccctgcccgattctcaggctccctccgttggggcaaagctgccctgacactgtctggtgtgcagcctgaggacgaggctgactattactgcctactctactttggtggtgctgtgtctagttcggcgggacgggaccaagctgaccgttacttaagtcagacccaaggctcgccccctcggtcactctcgttcccgt

SEQ ID NO: 785465 - DNA, 482 bp, Homo sapiens
  misc_feature: HIJSMM301BLJHT.52.37.D04.1.454.light.4.raw
cgcagtacgacacgaccggtgctcgatttagtagcatactgttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccgctctgaccatcagccgggacccaggctatggatgaggctgactattactagtcaggcgtgggacagcaacactgtggtacgttcggcggagggaccgaagctacgaccgtcctaggtccagccc

SEQ ID NO: 785466 - DNA, 513 bp, Homo sapiens
  misc_feature: HIJSMM301DQAIK.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtccaccgtcctaggtccagacccaacggcccaaccccactcgtcta

SEQ ID NO: 785467 - DNA, 511 bp, Homo sapiens
  misc_feature: HIJSMM301B0MAT.17.41.D08.1.454.light.4.raw
cgtagactagcacgaccggtgctcgatttagtcacgcgagaaagggaaaggggagagctgctcagttaggacccagagggaaccatggaaaccccagcgcagcttcccttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacaccccctcactttcggcggaggggccgaaggtggagatcaagcgaactgtggctgcaccatcctgtcttcatcttcccgccat

SEQ ID NO: 785468 - DNA, 505 bp, Homo sapiens
  misc_feature: HIJSMM301EJDKB.5.60.F05.1.454.light.4.raw
atcagacacgcacgaccggtgctcgatttagtacgtcatcagggaaagggtagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggcccatccgtgggctccagtctgaggatgagtctgattattactgtgcaacatgggatgacagctgaatggtcggtatcggcggaggaccgaagctgaccgtcctcggtcagcccaggctgccccctc

SEQ ID NO: 785469 - DNA, 525 bp, Homo sapiens
  misc_feature: HIJSMM301AIWHB.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcgacgggggcccaggcagacgatgaatgtgattatcactgcgttcctttatggtggggcgtggctagtttgggtgttcgggcgggagggaccaaactgaccgtcctaggtcacgccaaggcctcgccccctcggtcactctccg

SEQ ID NO: 785470 - DNA, 486 bp, Homo sapiens
  misc_feature: HIJSMM301EQ3DZ.41.44.D11.1.454.light.4.raw
tctatactatcacgaccggtgctcgatttagcgcagtacgaagggggcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcatttagtcatctctggggtccagtttgtggatgaggctgactactattgcacggtctggtacagcagcgctgtggtcttcggcggagggactgacttatcgtcctagtcagccaggctccg

SEQ ID NO: 785471 - DNA, 469 bp, Homo sapiens
  misc_feature: HIJSMM301BLLQW.52.8.A08.1.454.light.4.raw
cgcagtacgacacgaccggtgctcgatttagcatactctacagggggaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccaatcagcaggctgcagcctgaagatattgcaacatattactgtcaacagtatgattagtctcccgctcactttcggacggggggccgaaggtaggagatcaagcgaa

SEQ ID NO: 785472 - DNA, 513 bp, Homo sapiens
  misc_feature: HIJSMM301EMISB.15.66.F11.1.454.light.4.raw
tctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgatttataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgatttatttctgcggctcatatggagacaattacagtcttttgtcttcggaagtgggaccgaaggtcaccgtcctaagtcagcccaagccaacccactacgtcactctcgttcccaccctt

SEQ ID NO: 785473 - DNA, 517 bp, Homo sapiens
  misc_feature: HIJSMM301BIZH1.43.59.F04.1.454.light.4.raw
tgtgagtagtcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctcctgaccatctctgggctccaggctgaggacgaggctgattattactgcaactcacttacaacgaccgacacttgcgtattcggcggcgggaccaagctgaccgtcctaggtcacgcccgaaggctcgccccctcggtcactctcgtt

SEQ ID NO: 785474 - DNA, 502 bp, Homo sapiens
  misc_feature: HIJSMM301AI0I8.9.50.E06.1.454.light.4.raw
tgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctgaccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccgaacgggaccgaaagtaggacatcaagcgaactaggtggtcgtgcaccactcttacg

SEQ ID NO: 785475 - DNA, 494 bp, Homo sapiens
  misc_feature: HIJSMM301DCY71.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctaccctgaccattactgactccagcctgagacgaggctgactattactgctcagcatgggacagcagcctcacaaattggatgttcggcggacgggacaagctcgaccgtcctacggtcaagcccaac

SEQ ID NO: 785476 - DNA, 512 bp, Homo sapiens
  misc_feature: HIJSMM301A5ORV.43.34.D01.1.454.light.4.raw
tgtgagtagtcacgaccggtgctcgatttagatcgtctgtgttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgcttcatatgcaggtagttacacttatgtctttcggaatttgggacgacggttcaccgtcctacggtcagacccaagggacccaacccccga

SEQ ID NO: 785477 - DNA, 494 bp, Homo sapiens
  misc_feature: HIJSMM301BSSS6.46.26.C04.1.454.light.4.raw
  modified_base (55)..(55): a, c, t, g, unknown or other
actagcagtacacgaccggtgctcgatttagtctagcgactttgggtttggggtnatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtccccgctcacttttcggcggaggggaccaagggtggagagtacaaacgtaacg

SEQ ID NO: 785478 - DNA, 572 bp, Homo sapiens
  misc_feature: HIJSMM301CNQGV.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaacagtgactacttgggtgttcggcgggtacgggaccgaacggcgtcgtaacccgtccgttacgggtaccacggaccccgaaacgggccttcgccccccctccgggtcctaacctccgttcgtttcccccggccccttccccg

SEQ ID NO: 785479 - DNA, 508 bp, Homo sapiens
  misc_feature: HIJSMM301E2PN7.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccacctgaccatcagcagggtcgaagccggggatgaggccgactattactgtcaggtgtggatagtagtggtgatcatccactacgtcttcggaactgggaccaaggtctccgtcctacgtcagcccaaggccaacccactgtcactctgttcccgt

SEQ ID NO: 785480 - DNA, 515 bp, Homo sapiens
  misc_feature: HIJSMM301C7B61.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtcgggaccaagctgccgtcctaagtcagcccaaggctgccccctcggtccactctgttccccg

SEQ ID NO: 785481 - DNA, 503 bp, Homo sapiens
  misc_feature: HIJSMM301BPBOQ.13.25.C03.1.454.light.4.raw
tcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcgagggtccaaagtgaccgtctaggtcagcccaaggctgccccctggtcactc

SEQ ID NO: 785482 - DNA, 509 bp, Homo sapiens
  misc_feature: HIJSMM301ARK6Y.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtccgtgggtcagcccaaggcctcgccccctcggtctacc

SEQ ID NO: 785483 - DNA, 510 bp, Homo sapiens
  misc_feature: HIJSMM301DXVSK.4.57.F02.1.454.light.4.raw
  modified_base (483)..(483): a, c, t, g, unknown or other
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgaatcaatccatacgtcttcggaactgggaccgaaggtctaccgtcctaacgtnagcccaaggccaacgtccactgcactc

SEQ ID NO: 785484 - DNA, 474 bp, Homo sapiens
  misc_feature: HIJSMM301BYUSI.52.1.A01.1.454.light.4.raw
cgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtccatcaagttcagtggcagtggatctgggacagaattcactctcaccatcaccagtctgcaggctgaggattttgcaacttactctgtcaacagagttacagttccctcacctttcggccctgggaccatagtggatatcaaacgaactgtggctgccac

SEQ ID NO: 785485 - DNA, 451 bp, Homo sapiens
  misc_feature: HIJSMM301EA7LK.2.76.G10.1.454.light.4.raw
acgctcgacacacgaccggtgctcgatttagtcactcatacaggggtcctgggcccagtctgtgctgactcagccaccctcagcgtctgggcccccccgggcagagggtctccatctcttgttctggagtcacttccaacatcggaaataatgatgtgagctggtaccagcaggtcccaggaacggcccccaaactcctcatctataccaatgatgtgcggccctcagggggtccctgaccgattctctgcctccaagtctggcacgtcagccttcctggacatccgtggcctccagtctgcggatgaggctgtttatttctgttcagcacgggatgccagccggaatgggacaattgggtattcgggcggagggaccaagtttgaccgtcctaagtcagcccaaggctgccccctcggtcactctgttcccaccctcctctgtcgagcgt

SEQ ID NO: 785486 - DNA, 515 bp, Homo sapiens
  misc_feature: HIJSMM301ATVHF.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagccaggctgccccctcgtcactctcgttcccta

SEQ ID NO: 785487 - DNA, 448 bp, Homo sapiens
  misc_feature: HIJSMM301A6TBG.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaactagtttgggttgtttgggtgttcggcggagggaccaagctgaccgtcctaagtcagcccaaggctcgccccctcggtcactctcgttcccaccctcctccgtgtctgat

SEQ ID NO: 785488 - DNA, 509 bp, Homo sapiens
  misc_feature: HIJSMM301EKOTV.48.87.H10.1.454.light.4.raw
  modified_base (377)..(377): a, c, t, g, unknown or other
agtatacatacacgaccggtgctcgatttagcagtactgcgttgggtttggggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcgggtgggtctgggacagagttcactctcaccatcagcngcctgccagtctgaagattttacattttattactgttcagcagtatcgtaagtgactcgacgttgccaagggaccaaggtggaagtcaaacgaactagtggctgcgaccatctgtcttcatcttcccgccta

SEQ ID NO: 785489 - DNA, 473 bp, Homo sapiens
  misc_feature: HIJSMM301B6913.48.69.G03.1.454.light.4.raw
agtatacatacacgaccggtgctcgatttagtcgctgcgtaaaggagaaagggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaaggggacacgactggagattaaccgaactgtggctgcaccatctgtcttcattcttcccgccatcctggactatgtatact

SEQ ID NO: 785490 - DNA, 391 bp, Homo sapiens
  misc_feature: HIJSMM301A3MWN.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattcgtctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctcgttcccaccctcctccgagcgacga

SEQ ID NO: 785491 - DNA, 503 bp, Homo sapiens
  misc_feature: HIJSMM301DP8TS.18.78.H01.1.454.light.4.raw
tacgagtatgcacgaccggtgctcgatttagtgtgagtagtttgggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctagtcagcccaaggccaacccca

SEQ ID NO: 785492 - DNA, 513 bp, Homo sapiens
  misc_feature: HIJSMM301B99S4.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcgtcactctgttccccg

SEQ ID NO: 785493 - DNA, 495 bp, Homo sapiens
  misc_feature: HIJSMM301DT8TS.41.54.E10.1.454.light.4.raw
tctatactatcacgaccggtgctcgatttagatcgtagcagaacacacaaaggggactgatcaggactcctcagttcaccttctcacaatgaggctccctgctcagctcctggggctgctaatgctctgggtcccaggatgcagtggggatgctattctgactcagtcgccgctctccctgcccgtctcccttggacagccggcctccatttcctgcacgtctagtcaaagtctcctacatgatgatggaaacacctacctgacttggtttcaccacaggccaggccaatctccaaggcgcctaatttatcaggtttcgaagcgggactctggggtcccaggcagattcagcggcagtgggtcaggctctgctttcacgctgagaatcaacagggtggaggctgaggatgttggtgtttattactgcatgcaaggttcatattggccgtgctagttttggccgaggggaccaagttggagatacaaacgaactgt

SEQ ID NO: 785494 - DNA, 494 bp, Homo sapiens
  misc_feature: HIJSMM301AIUVD.4.24.C02.1.454.light.4.raw
agcactgtagcacgaccggtgctcgatttagtacagatcgttagggaaaggggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtacaacaatataacagtttattggacgttcggaccgaagggaccaaggtggaaatcagacgaactgtgctgcaccatctgtcttct

SEQ ID NO: 785495 - DNA, 510 bp, Homo sapiens
  misc_feature: HIJSMM301AQMBM.27.78.H01.1.454.light.4.raw
  modified_base (424)..(424): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatcgtgggacacatttcacccctcacccatccaatagcctggaagctaggaanatgcctgacaacttattactgtcatcagagtactactttacctcaagtgatcaccttcggccaaggacacgactggagattaaacg

SEQ ID NO: 785496 - DNA, 476 bp, Homo sapiens
  misc_feature: HIJSMM301DJ68G.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactatactgtcagcgtggacatcagcagtgaggtggttttcggcggagggccaagctgaccgtcctaagtcagaccccg

SEQ ID NO: 785497 - DNA, 503 bp, Homo sapiens
  misc_feature: HIJSMM301B9YZ4.48.27.C05.1.454.light.4.raw
  modified_base (438)..(438): a, c, t, g, unknown or other
  modified_base (440)..(440): a, c, t, g, unknown or other
agtatacatacacgaccggtgctcgatttagacgcgatcgaagggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggcctcaggggtccctgatcgcttctctggctccaagtctggcaacacggcctccctgaccgtctcgtgggctccaggctgaggatgaggctgattattactgcagctcatatgcaggcagcaanangtggtattcggcggagggaccaggctgaccgtcctaggtcacgccaaggctcgccccctggta

SEQ ID NO: 785498 - DNA, 503 bp, Homo sapiens
  misc_feature: HIJSMM301EUVK2.41.14.B03.1.454.light.4.raw
tctatactatcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcgggcggagggaccaagctgacctcctaggtcagcccaaggctcgccccctc

SEQ ID NO: 785499 - DNA, 492 bp, Homo sapiens
  misc_feature: HIJSMM301BNIZK.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaagtgatcaccttcggccaagggacacgactaggagattaaacgaatgtggctgcaccatctgt

SEQ ID NO: 785500 - DNA, 520 bp, Homo sapiens
  misc_feature: HIJSMM301ALUI4.27.23.C01.1.454.light.4.raw
  modified_base (416)..(416): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattatattntagttcatatacaaccagtgacacttgggtgttcggcggagggaccaggctgaccgtcctaggtcagcccaaggctgccccctcggtcactctgttcccaccct

SEQ ID NO: 785501 - DNA, 494 bp, Homo sapiens
  misc_feature: HIJSMM301D0VKY.43.28.C06.1.454.light.4.raw
  modified_base (476)..(476): a, c, t, g, unknown or other
tgtgagtagtcacgaccggtgctcgatttagagctcacgtattgggtttggggagagctgctcagttaggacccagagggaaccatggaaaccccagcgcagcttctcttcctcctgctactctggctcccagataccaccggagaaattgtgttgacacagtctccaggcaccctgtctttgtctccaggggacagaggcaccctctcctgcagggccagtcagactgttagcagcagcagcttagcctggtaccagcagaaacctggccaggctcccaggctcctcatctatggtacatccaacagggccactggcataccagacaggttcggtggcagcgggtctgggacagacttcactctcaccatcagcagactggagcctgaagattttgcagtgtattactgtcagcagtatggtagctcacagggggacgttcggccaagggaccgaaggtggaaatcaaacgaacngtaggctgcaccatctgt

SEQ ID NO: 785502 - DNA, 509 bp, Homo sapiens
  misc_feature: HIJSMM301BM5QZ.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggacaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggttatttggtggagggaccaagctgaccgtcctaggtcagcccaaggctgccccctcggt

SEQ ID NO: 785503 - DNA, 510 bp, Homo sapiens
  misc_feature: HIJSMM301D90N8.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactcctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactcgtcta

SEQ ID NO: 785504 - DNA, 501 bp, Homo sapiens
  misc_feature: HIJSMM301EL4FN.48.28.C06.1.454.light.4.raw
  modified_base (242)..(242): a, c, t, g, unknown or other
  modified_base (487)..(487): a, c, t, g, unknown or other
agtatacatacacgaccggtgctcgatttagagctcacgtattgggtttgggggctgtgggctcaggaggcagagctctgggaatctcaccatggcctggacccctctcctgctccccctcctcacttttctgcacagtctctgaggcctcctatgagctgacacagccaccctcggtgtcagtgtccccaggacaaacggccaggatcacctgctctggagatgcattgccaaaaaaaatntgcttattggtaccagcagaagtcaggccaggcccctgtgctggtcatctttgaggacaacaaaccgaccctccgggatccctgagagattctctggctccagctcagggacaatggccaccttgactatcaatggggcccaggtgacgatgaggctgactactactgttcctcaacagacagtagtggtgatcgagggctgttcggcggagggaccaagctgaccgtctaagtcagcccaggcngcccctcggtctac

SEQ ID NO: 785505 - DNA, 544 bp, Homo sapiens
  misc_feature: HIJSMM301AS003.27.23.C01.1.454.light.4.raw
  modified_base (227)..(227): a, c, t, g, unknown or other
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcgggtagggacccagggcctggaccgtccttaggtctaggcccaagggactcggccccctcggtccactctcgttcccctaccctcccc

SEQ ID NO: 785506 - DNA, 514 bp, Homo sapiens
  misc_feature: HIJSMM301AORF4.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagctaggtttcggcggtgggaccgaagctgaccgtcctaagtcagcccaaggctcgccccctcggtccactcctcgtt

SEQ ID NO: 785507 - DNA, 515 bp, Homo sapiens
  misc_feature: HIJSMM301ASDXF.49.82.H05.1.454.light.4.raw
agtcgagagacacgaccggtgctcgatttagtcgagctctctcgcgggcacgaccggtgctcgatttagtatctgatagttgggtttggggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaactaccccggcaaagtccccaaactcatgatctttgaggtcagtgatcggccgcaggggtttctcatcgcttctccggctccaagtctggcagcacggcctccctgaccatctctgggctccaggctggaggacgaggctgattattactgcagctcatactaacaaacataaacacttgggtgttcggcggcgggaccaactacg

SEQ ID NO: 785508 - DNA, 528 bp, Homo sapiens
  misc_feature: HIJSMM301AKPHU.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcggacgggaccgaggctgaccggtcctaggtcagcccaaggctcgccccctcggtcactctcgttcccgccct

SEQ ID NO: 785509 - DNA, 524 bp, Homo sapiens
  misc_feature: HIJSMM301ASWY1.27.23.C01.1.454.light.4.raw
  modified_base (520)..(520): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccgaggctgaccgtcctacggtcagcccaaggctcgccccctcggtcactctgttcccnccct

SEQ ID NO: 785510 - DNA, 510 bp, Homo sapiens
  misc_feature: HIJSMM301B20PI.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactggaccaaggtctccgtcctacgtcagcccaaggcccaaccccactgtcactcttccg

SEQ ID NO: 785511 - DNA, 498 bp, Homo sapiens
  misc_feature: HIJSMM301EME83.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacagcactctctatgtcttcggaactgggaccaaggtccaccgtctaggtcacgcccaagga

SEQ ID NO: 785512 - DNA, 491 bp, Homo sapiens
  misc_feature: HIJSMM301BK9TC.51.6.A06.1.454.light.4.raw
  modified_base (464)..(464): a, c, t, g, unknown or other
  modified_base (481)..(481): a, c, t, g, unknown or other
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcngccaaggccaacccacngtcactctcg

SEQ ID NO: 785513 - DNA, 503 bp, Homo sapiens
  misc_feature: HIJSMM301BE7BT.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctaccgggagtcccggggtccctgaccgattcagaggcagcgggtctgggacagatttcactcctcaccatcaccaacctgcaggctagaagatgtggctagtttatactgtcagcaatactatagtcctcctctcacgttcggcggagggaccaggtgagatacaaacgaactgtggctgctaccatctgtctt

SEQ ID NO: 785514 - DNA, 500 bp, Homo sapiens
  misc_feature: HIJSMM301C5O1A.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcaggtggcagtgagtctgggacagacttcactctcaccatcagcagcctagagcctgaagtattttgctactttattactgtcagcagcgtagcaactggcctctcactttcggcggagggaccgaggggtggagatcgagaacgaacgtgtcggct

SEQ ID NO: 785515 - DNA, 506 bp, Homo sapiens
  misc_feature: HIJSMM301DZFBA.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgagatattgcagtttattattgtcagcagcgtagcaggtggcctttcactttcggcccggggaccaaagtggaaatcaaacgaactgtggctgcaccatctgtcttcatcttcccgcc

SEQ ID NO: 785516 - DNA, 498 bp, Homo sapiens
  misc_feature: HIJSMM301DXUSG.2.49.E05.1.454.light.4.raw
  modified_base (467)..(467): a, c, t, g, unknown or other
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgagctgattattactgtgttggatgggacagcagcctgagtgcttatgtnttcggaactcgggaccacggtcaccggtcct

SEQ ID NO: 785517 - DNA, 352 bp, Homo sapiens
  misc_feature: HIJSMM301AS5D0.13.11.A11.1.454.light.4.raw
tcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggccaggggaccaagctggagatcaagcgaactgtggctgcaccatctgtcttcatcttcccgccatctgatagtacgtga

SEQ ID NO: 785518 - DNA, 503 bp, Homo sapiens
  misc_feature: HIJSMM301AXFMG.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctagaagatgtggcagtttattattgtcagcaatatatatcctcctcagacgttcggccaagggaccgaaggtgggaaatcaaaacgaactgtggtctgtcaccgta

SEQ ID NO: 785519 - DNA, 500 bp, Homo sapiens
  misc_feature: HIJSMM301EJ0W0.53.35.D02.1.454.light.4.raw
  modified_base (482)..(482): a, c, t, g, unknown or other
cgcgtatacacacgaccggtgctcgatttagcacacgatagttgggtttggggggggctcaggaggcagagctctgggaatctcaccatggcctggacccctctcctgctccccctcctcactttctgcacagtctctgaggcctcctatgagctgacacagccaccctcggtgtcagtgtccccaggacaaaacggccaggatcacctgctctggagatgcattgccaagaaaatatgcttattggtacagcagaggtcaggccaggcccctgtgctggtcatctatgaggacaccaaacgaccctccgggatccctgcgagattctctggcgccagctcagggacagtggccaccctgacagtcagtggggccaggtggaggatgaagctgattactactgttactcaacagacaggagtggaaatcatagggtattcggacggagggaccaactgaccgtcctaggtcagcccaaggcngcccctcgtcactctgtt

SEQ ID NO: 785520 - DNA, 488 bp, Homo sapiens
  misc_feature: HIJSMM301EJ4MA.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagacgtggagcctgaagattttgcagtctattactgtcagcagtatggtcacgtcccaagtaacttttggccaggggaccaagctggagatcaaacgaactggtgctgcaccat

SEQ ID NO: 785521 - DNA, 513 bp, Homo sapiens
  misc_feature: HIJSMM301DBHJB.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgaggtcggccgtccgggggccacgtttccggcccgtcgggaccaaagtggatatacaaacgaactgtggctgcaccatctgtctt

SEQ ID NO: 785522 - DNA, 501 bp, Homo sapiens
  misc_feature: HIJSMM301AN2YA.5.86.H09.1.454.light.4.raw
  modified_base (324)..(324): a, c, t, g, unknown or other
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctnaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtctaggtcagcccaaggctcgccccctc

SEQ ID NO: 785523 - DNA, 506 bp, Homo sapiens
  misc_feature: HIJSMM301COLBB.5.86.H09.1.454.light.4.raw
  modified_base (366)..(366): a, c, t, g, unknown or other
atcagacacgcacgaccggtgctcgatttagtgctatagacttggggtttggggggggtctcaggaggcagcgctctcaggacgtcaccaccatggcctgggctctgctcctcctcaccctcctcactcagggcacagggtcctggggcccagtctgccctgactcagcctccctccgcgtccgggtctcctggacagtcagtcaccatctcctgcactgggaccagcagtgacattggtcgttataactatgtctcctggtaccaacaacatccaggcaaagacccccaaactcgtgatttctgaggtcagtaagcggccctcgaggggtccctgatcgcttctctggctccaagtctggcaacncggcctccctgaccgtctctgggctccagactgaggatgaggctgactattactgcagctcatttgcaggcagccgtatactcttcggcggagggaccagactgaccgtcctaggtcagcccaaggctgccccctcggtc

SEQ ID NO: 785524 - DNA, 518 bp, Homo sapiens
  misc_feature: HIJSMM301ESRSY.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctggtccactctgttccccaccctccctcc

SEQ ID NO: 785525 - DNA, 513 bp, Homo sapiens
  misc_feature: HIJSMM301EMZD4.40.53.E09.1.454.light.4.raw
tctagcgactcacgaccggtgctcgatttagagagagtgtgttgggtttgggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagacccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatggtggggggtgccgtacgttgggtggttcggcgggagggaccaagctgaccgtcctaggtcagcccaaggcctcgccccctc

SEQ ID NO: 785526 - DNA, 517 bp, Homo sapiens
  misc_feature: HIJSMM301C3NQN.43.23.C01.1.454.light.4.raw
tgtgagtagtcacgaccggtgctcgatttagtacacgtgattagggattgggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcggtgggtgttcggcggagggaccaagctgaccgtcctgggtcagcccaaggcctgccccctcggtcactctcgttcccaccctccc

SEQ ID NO: 785527 - DNA, 501 bp, Homo sapiens
  misc_feature: HIJSMM301DM3J3.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtcccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtgggtcccatcaaggttcaggcggcactggatctgggacagaattcactctcaccatcaacagcctgcagcctgatgatttggactaacttactactcgaccaacgtatagtacttatttgtctaccttcggccaagggacacgactggagtattaaacgtaacgtgt

SEQ ID NO: 785528 - DNA, 530 bp, Homo sapiens
  misc_feature: HIJSMM301AX2S0.40.23.C01.1.454.light.4.raw
tctagcgactcacgaccggtgctcgatttagtacacgtgattagggagttagggaggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcactgttttggcggtttctccgactttcggtcggacgggtaccgaacggttggagggtccgaaacggaaactggtggcttggcaccgactcttcgtcttctacttccttcccgt

SEQ ID NO: 785529 - DNA, 516 bp, Homo sapiens
  misc_feature: HIJSMM301B95X9.47.85.H08.1.454.light.4.raw
  modified_base (444)..(444): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtnttcgggcggagggaccaaggttcgaccggttcctaggtcagtcccaaggctcgccccctcggccactctgtt

SEQ ID NO: 785530 - DNA, 511 bp, Homo sapiens
  misc_feature: HIJSMM301EXLHS.43.35.D02.1.454.light.4.raw
  modified_base (466)..(466): a, c, t, g, unknown or other
  modified_base (490)..(490): a, c, t, g, unknown or other
tgtgagtagtcacgaccggtgctcgatttagcacacgatagttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtgggtcccattaaggttcagcggcagtggatctgggacagagtttactctcaccatcagcagcctgcagcctgatgattttgcaacttattactgccaacaatatgtattcttggccgtggacgttcggtccgaacgggaacgaacgtaggaaanacaaacgaactaacgtggtctggnaccaatctgtcttctattccc

SEQ ID NO: 785531 - DNA, 509 bp, Homo sapiens
  misc_feature: HIJSMM301B1AMB.43.25.C03.1.454.light.4.raw
tgtgagtagtcacgaccggtgctcgatttagtagtgtagatttgggtttggggactgatcaggactcctcagttcaccttctcacaatgaggtctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtactgaccgcgactctggggtcccagacagattcagcggcagtgggtcaggcactgatttcacactgaagatcagcagggtggaggctgaggatggttggggtttattactgcatgcaaggtacacactggcccgtccaccttcggccaagggaccacgacgtaggagaagttaaacgaactcgtaggctgcaa

SEQ ID NO: 785532 - DNA, 519 bp, Homo sapiens
  misc_feature: HIJSMM301DWMS4.52.16.B05.1.454.light.4.raw
cgcagtacgacacgaccggtgctcgatttagagctcacgtaaggggctgggcctaaggaagcagcactggtggtgcctcagccatggcctggaccgttctcctcctcggcctcctctctcactgcacagactatgtgacttcctatgtgctgactcagccaccctcggcgtcagtggccccaggacagacggccacgattacctgtgagggaaactacattgaaaggaaaagtgtccattggtatcagcagaagccaggccaggcccctgtgctggtcctccatgatgatagcgaccggccctcagggatccctgagggattctccggctccaactctgggaacacggccaccctgaccatcagcagggtcgaagccggagatgaggccgactattactgtcaggtgtgggatcgtgatagtgaccattgggtgttcgggcggagggaccaagttgtaccgtcctaagtcagcccaaggctcgccccctcggtcactctcgttcccaccctcctctacg

SEQ ID NO: 785533 - DNA, 510 bp, Homo sapiens
  misc_feature: HIJSMM301EHLXK.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacaccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcaactactgttcgtttgggtgttcggcggaggaccaagttgaccgtcctaggtcacgcccaaggctcgccccctcggtccactctgtt

SEQ ID NO: 785534 - DNA, 492 bp, Homo sapiens
  misc_feature: HIJSMM301BNABT.4.59.F04.1.454.light.4.raw
  modified_base (394)..(394): a, c, t, g, unknown or other
  modified_base (485)..(485): a, c, t, g, unknown or other
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcacctgcagtctgaagattcngctagtttattattgtcaccagtattatagttggcctccggtgtacgttcgccgaggaccaagtggaatcgaacaactgtggctgcactanctgtcta

SEQ ID NO: 785535 - DNA, 509 bp, Homo sapiens
  misc_feature: HIJSMM301B86YA.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcagtattatagtactcctccgacgttcgccaagggaccaaggtggagattaaacgaactgtggctgcacccatcttcgtcttcattccttcccgccatctgacatactacg

SEQ ID NO: 785536 - DNA, 487 bp, Homo sapiens
  misc_feature: HIJSMM301ALXN1.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagcctcctgatctatgatgtctccaatatggaaagtggggtcccatcaaggttcagcggcagtggatctgggacagaattcactctcaccatcagcagcctacagcctgatgattttgcgacttattattgccaacagtataagagttattctaactttacgccctgggaccaatgtggatatacaaacgaactagtggctgcaccagtctgtt

SEQ ID NO: 785537 - DNA, 489 bp, Homo sapiens
  misc_feature: HIJSMM301CH8TX.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgattatttattcttccagcgttcggccaggggaccaaggtggaagtcaagcgactgtggctgcacatctgtt

SEQ ID NO: 785538 - DNA, 495 bp, Homo sapiens
  misc_feature: HIJSMM301DTN62.10.72.G06.1.454.light.4.raw
catagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgctctctgcctccaagtctggcaacacggcttccctgaccatctccgggctccacgctgaggacgaggctcattattacttgcagctcatatacacccagggccactctcgtgatattcggtcggagggacctgggctgaccgtcctacgtcagcccaac

SEQ ID NO: 785539 - DNA, 498 bp, Homo sapiens
  misc_feature: HIJSMM301EI1Q9.48.82.H05.1.454.light.4.raw
agtatacatacacgaccggtgctcgatttagtcgagctctctcgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcgggcggagggaccaagctgaccgtctaggtcagcccaaggctccg

SEQ ID NO: 785540 - DNA, 506 bp, Homo sapiens
  misc_feature: HIJSMM301AJATI.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagtattttgctagttttattactgtcagcagcgtagcaacgtcggccgtcggacggttcggaccgaagggaaccgaagaggacatacaagacgaactgtggcgtgcaccatctcgttc

SEQ ID NO: 785541 - DNA, 522 bp, Homo sapiens
  misc_feature: HIJSMM301DWB1L.7.34.D01.1.454.light.4.raw
cgtgtctctacacgaccggtgctcgatttagatcgtctgtgttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacgaggggacagcatttagtttgggtgttcgggcggtagggaccaagctgaccgtcctgcgtcagcccaaggctcgccccctcggtccacttcc

SEQ ID NO: 785542 - DNA, 507 bp, Homo sapiens
  misc_feature: HIJSMM301CWQ2V.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagattcactctcaccatcagcagcctgcaggttgaagatgtaggcagtttattactgtcagcagtattatactactcctctgacgttggccaagggaccgaacggtaggaggatacaaacgaaacgtatggctgtcaccaatcttcg

SEQ ID NO: 785543 - DNA, 508 bp, Homo sapiens
  misc_feature: HIJSMM301A98CV.40.37.D04.1.454.light.4.raw
tctagcgactcacgaccggtgctcgatttagtagcatactgttgggtttgggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctcgtcttcactccttcccgccatct

SEQ ID NO: 785544 - DNA, 509 bp, Homo sapiens
  misc_feature: HIJSMM301B70RJ.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggcccctcgagggatccctgagccgattctctggcgccagctcgaggaacagtagtcacgttgaccatcagtggagtccaggcagaagacgaggctgactattattgtcaagcagtagacagcagtggtccttagtcggtgttcgggcgggggaccaaggctagaccgtcctaggtcacgccaaggctcgccccgtcggtcactcg

SEQ ID NO: 785545 - DNA, 513 bp, Homo sapiens
  misc_feature: HIJSMM301CBTI6.47.85.H08.1.454.light.4.raw
  modified_base (482)..(482): a, c, t, g, unknown or other
  modified_base (505)..(505): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactggttcggtttgggtggttcggcgggagggacaagttgaccgtcctaggtcngccaagctcgccccctcggtccnctctcgtt

SEQ ID NO: 785546 - DNA, 443 bp, Homo sapiens
  misc_feature: HIJSMM301ANPPO.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagacccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctcgccccctcggtcactctgttcccgccctcctcgtatctctcg

SEQ ID NO: 785547 - DNA, 516 bp, Homo sapiens
  misc_feature: HIJSMM301CAE6G.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaaggctgccctgaccctttcgggtgcgcagcctgaggatgaggctgagtattactgcttgctctcctatagtggtgttcgggtgttcggcggagggaccaagctgaccgtcctaggtcagccaaggctgccccctcggtcactctcgttcccgaccctcctcctagtcctacg

SEQ ID NO: 785548 - DNA, 526 bp, Homo sapiens
  misc_feature: HIJSMM301BLYM7.12.21.B10.1.454.light.4.raw
  modified_base (521)..(521): a, c, t, g, unknown or other
atacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggacgcgggaccaaagtgaccgtactaagtcaggcccaaggctcgccccctcggtccactctgttcccnccctt

SEQ ID NO: 785549 - DNA, 506 bp, Homo sapiens
  misc_feature: HIJSMM301AYVO3.47.78.H01.1.454.light.4.raw
  modified_base (271)..(271): a, c, t, g, unknown or other
  modified_base (468)..(468): a, c, t, g, unknown or other
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccngaggccaggcccatctccaaggcgcctaatttataagctttctaccgggactctggggtcccagacagattcagcggcagtggcactgatgtcacactgacaatcagcagggtggaggctgaggatggttggggtttcgttctccatgcaaggtacacactggccttttggccgacgggggaccaaacccgtggganagtcaaaactgaactgtggctggcacccatctgttctt

SEQ ID NO: 785550 - DNA, 488 bp, Homo sapiens; identical to SEQ ID NO: 573804
  misc_feature: HIJSMM301AQBKR.46.35.D02.1.454.light.4.raw

SEQ ID NO: 785551 - DNA, 520 bp, Homo sapiens
  misc_feature: HIJSMM301AK6U2.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgttggtttcggcggaggcacgaagtgaccgtcctcggtcacgcccaggcctcgcccccctcggtcactcttccg

SEQ ID NO: 785552 - DNA, 516 bp, Homo sapiens
  misc_feature: HIJSMM301DL7MF.17.33.C11.1.454.light.4.raw
  modified_base (457)..(457): a, c, t, g, unknown or other
cgtagactagcacgaccggtgctcgatttagagtgagctcgttgggtttggggggcgccaggggtcccttccaatatcagcaccatggcctggactcctctctttctgttccttcctcacttgctgcccagggtccaattctcagactgtggtgactctaggagccctcactgactgtgtccccaggagggacagtcactctcacctgtgcttccaacactggagcagtcaccagtgcttactatccaaactggttccagccagaaacctggacaagcacccagggcactcatttatagtacaaacaacaaacactcctggacccctgcccgattctcaggctccctccttggggcaagctgcctgacactgtctggtgtgcagcctgaggacgaggctgactattactgctactctactttggtggtgctgtgctatcggtcggaggaccgaagcngacgtccttaagtcagcccaagcgtgcccccgtcggtccactctgttcccgcccctctt

SEQ ID NO: 785553 - DNA, 508 bp, Homo sapiens
  misc_feature: HIJSMM301EOYB1.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcaatatacaatcagcaacacttatgtcttgggactgggaccaagatccaccgtcctaggtcagcccaaaggccaaacccactcgtctac

SEQ ID NO: 785554 - DNA, 528 bp, Homo sapiens
  misc_feature: HIJSMM301A9VHA.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacgttgggtgttcggcggcgggaccaagtcgaccgtcctaagtcagcccaaggctcgccccctcggtcactctcgttcccgcccttccc

SEQ ID NO: 785555 - DNA, 515 bp, Homo sapiens
  misc_feature: HIJSMM301BA527.48.68.G02.1.454.light.4.raw
  modified_base (488)..(488): a, c, t, g, unknown or other
agtatacatacacgaccggtgctcgatttagtcgatagtgaagggaaagggggggggagcctagctgtgctgtgggtccaggaggcagaactctgggtgtctcaccatggcctgggtccccctacttctccccctcctcactctctgcacaggctctcaggcctcctatgagttgacacagccaccctcggtgtcagtgtccccaggacagacggccaggatcacctgctctggagatggattgccaacacaatatgcgtactggtaccagagaagccaggccaggcccctgtttggtgatatatcaagacactcagagggcctcagggacccctgagcggttctctggctccagctcaggggcaacagtcgcgttgacaatcagggaagtccaggcagaggacgaggctgactattactgtcagtctgcagacaacggaggtacttaacttggttcttggcggaggaccaagttgacgtcctggtcnggcccaaggctacgccccctcggtcta

SEQ ID NO: 785556 - DNA, 522 bp, Homo sapiens
  misc_feature: HIJSMM301AL44S.10.26.C04.1.454.light.4.raw
  modified_base (469)..(469): a, c, t, g, unknown or other
  modified_base (472)..(472): a, c, t, g, unknown or other
  modified_base (489)..(489): a, c, t, g, unknown or other
  modified_base (497)..(497): a, c, t, g, unknown or other
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctggggacagacttcattctcaccatcaacagactgcagcctgaagatattgcagtttactactgtcagcagtatgttacgtccccgtggacgtcgtcgaacggacgagtaggnaancaacgaactacgtggcngcaccacnctgtcttctactacttcccgtccta

SEQ ID NO: 785557 - DNA, 495 bp, Homo sapiens
  misc_feature: HIJSMM301ECW7K.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaacaccttcggaccaagggacacgactggagattaaaggaactgtggctgcaccatctgtcttctatcttccccg

SEQ ID NO: 785558 - DNA, 515 bp, Homo sapiens
  misc_feature: HIJSMM301EBYC7.4.39.D06.1.454.light.4.raw
  modified_base (398)..(398): a, c, t, g, unknown or other
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagccctccctccgcgtcccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctnaggggggatgaggctgattattattgctagctcatatgtcaggcagttacaatgttgagtaattcgcggagggaccaaactgaccgtcctaggtcacgcccaacggctgccccctcc

SEQ ID NO: 785559 - DNA, 523 bp, Homo sapiens
  misc_feature: HIJSMM301A8M8D.41.57.F02.1.454.light.4.raw
  modified_base (505)..(505): a, c, t, g, unknown or other
tctatactatcacgaccggtgctcgatttagctcgatatagttgggtttgggggtgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcgaccgggggtcgagggccggggatggaggccacctactattgtcacgtctgggagactggtgatgatcctgtggcgctattcggcggagggacgaagctgccgtcctgggtcagcccaaggctcgcccctcggtcnctctcgtcccgccctcct

SEQ ID NO: 785560 - DNA, 517 bp, Homo sapiens
  misc_feature: HIJSMM301DPZ2Y.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgtttcgggcggagggaccaggcctgaccgtcctaggtcagcccaaggctgccccctcggtcactctgtcc

SEQ ID NO: 785561 - DNA, 491 bp, Homo sapiens
  misc_feature: HIJSMM301A164M.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggagtgtcggggtttactactgcatgcagggtacactctggccgttcacttttggccaggggaccaatcggatatcagacgaactgtggctgcta

SEQ ID NO: 785562 - DNA, 499 bp, Homo sapiens
  misc_feature: HIJSMM301CI2C3.13.56.F01.1.454.light.4.raw
  modified_base (458)..(458): a, c, t, g, unknown or other
tcacgtactacacgaccggtgctcgatttagcagacgtctgaacacacaaaggggagagctctggggaggaactgctcagttaggacccagatggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggcccactggtatcccagaccggttcagtggcagtgggtctgggacagacttcactctcaccatcagcagtctgcagtctgaagattttgctagtttattactgtcagcagtataataactggcctccgtacatgtanacttttggcctacggggaccaacctggagatcagacgaacg

SEQ ID NO: 785563 - DNA, 449 bp, Homo sapiens
  misc_feature: HIJSMM301E35FL.2.76.G10.1.454.light.4.raw
acgctcgacacacgaccggtgctcgatttagtcactcatacagggtcctgggcccagtctgtgctgactcagccaccctcagcgtctgggcccccccgggcagagggtctccatctcttgttctggagtcacttccaacatcggaaataatgatgtgagctggtaccagcaggtcccaggaaccggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatgggcaattgggtattcggcggagggaccaagttgaccgtcctaagtcagcccaaggctgccccctcggtcactctcgttcccacccctcctctgtcgagcgt

SEQ ID NO: 785564 - DNA, 504 bp, Homo sapiens
  misc_feature: HIJSMM301AP93I.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcgagggatccctgagcgattctctggctcaactctgggaacacggccaccctgaccatcagcagggtcgaagccggggatgagccgactattactgtcaggtgtgggatagtagtggtgatcatccatacgtcttcggaactgggaccaaggtctccgtcctacgtcagcccaaggccaactccactgtcactc

SEQ ID NO: 785565 - DNA, 503 bp, Homo sapiens
  misc_feature: HIJSMM301A2F4I.48.35.D02.1.454.light.4.raw
agtatacatacacgaccggtgctcgatttagcacacgatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagtattttgcggtttattactgtcagcagcgtgccaactggcctctcacgttcggcggagggaccaaggtggacatcaaacgaactgtggctgcacatctgtcttcatctccccg

SEQ ID NO: 785566 - DNA, 506 bp, Homo sapiens
  misc_feature: HIJSMM301DMYQ1.7.71.G05.1.454.light.4.raw
  modified_base (205)..(205): a, c, t, g, unknown or other
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacctttcggccctgggaccaaagtggatatcaaacgaactgtggctgcaccatctgtctt

SEQ ID NO: 785567 - DNA, 510 bp, Homo sapiens
  misc_feature: HIJSMM301AMVLT.22.86.H09.1.454.light.4.raw
acatacgcgtcacgaccggtgctcgatttagtgctatagacttggggtttggggggggtctcaggaggcagcactctcgggacgtctccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggaggaccagctgaccgtcctaggtcagcccaaggctcgccccctcggtcacttc

SEQ ID NO: 785568 - DNA, 506 bp, Homo sapiens
  misc_feature: HIJSMM301BO0L6.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccggctcactttcggcgggtagggaccgtaggggtggaggatcaaacgaactagtggctggcaccagtctgtacttcgtatt

SEQ ID NO: 785569 - DNA, 515 bp, Homo sapiens
  misc_feature: HIJSMM301A5X5B.5.86.H09.1.454.light.4.raw
atcagacacgcacgaccggtgctcgatttagtgctatagacttggggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcgaggggtccctgatcgcttctctggctccaagtctggcaacacggcctccctgaccgtctctgggctccagactgaggatgaggctgactattactgcagctcatttgcaggcagccgtatacctcgttcggcggagggaccaagctgaccgtcctaggtcacgcccaaggcctcgccccctcggtcctacc

SEQ ID NO: 785570 - DNA, 440 bp, Homo sapiens
  misc_feature: HIJSMM301BOR49.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtattggctgttcgcggcggacagttgaccgtctacgtcagcccaaggctgccccctcggtcactctcgttcccaccctcctcgactacgcgag

SEQ ID NO: 785571 - DNA, 506 bp, Homo sapiens
  misc_feature: HIJSMM301EO70J.51.23.C01.1.454.light.4.raw
cgatcgtatacacgaccggtgctcgatttagtacacgtgattagggattggggggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagtattttgctagtttattactgtcagcagcgtaacaactggctctctttcggcggagggaccaaggtggagatcaaacgaactgtggctgcaccatctgtcttcattccttcccgccat

SEQ ID NO: 785572 - DNA, 493 bp, Homo sapiens
  misc_feature: HIJSMM301AK2FD.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactagtcagcagcgtagcaactggcctcggacgtcgtcaaggaccgaaacgaggacatctaacgcgaaactgtaggctgcaccactct

SEQ ID NO: 785573 - DNA, 464 bp, Homo sapiens
  misc_feature: HIJSMM301AQMBQ.26.78.H01.1.454.light.4.raw
  modified_base (446)..(446): a, c, t, g, unknown or other
  modified_base (453)..(453): a, c, t, g, unknown or other
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggctctcactttcggcggagggaccagggtggagattcagacgaactgtggctgcaccatctgtcttcatcttcccnccatctnaagtatagtct

SEQ ID NO: 785574 - DNA, 505 bp, Homo sapiens
  misc_feature: HIJSMM301BKB01.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtgcctttcactttcggcccggggaccaaagtggaaatcaaacgaactgtggctgcaccatctgtcttcatcttccgcc

SEQ ID NO: 785575 - DNA, 520 bp, Homo sapiens
  misc_feature: HIJSMM301AMZEQ.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccattagcgcggtcgaagccggagatgaggccgactattactgtcaggtgtgggacagtaatagtgatcccgagcgaggttttcgggcggtgggaccaagctgaccgtcctaagtcagcccaaggctcgccccctcggtccactctcgttccccta

SEQ ID NO: 785576 - DNA, 493 bp, Homo sapiens
  misc_feature: HIJSMM301A9X61.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcgagggtggaggcgtgaagatggtcggggttttattactgcatgcgagggtacagtgtggccttcgctcgcattcggcggagggaccgaaggtaggagatacaacg

SEQ ID NO: 785577 - DNA, 504 bp, Homo sapiens
  misc_feature: HIJSMM301DPP4N.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgtcggtccgaggaccgaaggtacggaagtcgaaacgaacgtagtaggctcggcaccactcttcgttcc

SEQ ID NO: 785578 - DNA, 510 bp, Homo sapiens
  misc_feature: HIJSMM301AEXX0.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggactgggaccaggtctccgtcctacgtcagcccaaggcccaaccccactcgtcactctgttccccta

SEQ ID NO: 785579 - DNA, 481 bp, Homo sapiens
  misc_feature: HIJSMM301EXR2F.7.67.G01.1.454.light.4.raw
cgtgtctctacacgaccggtgctcgatttagagtatacatattgggtttggggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacacgcccccaaactcctcatatacgagaacaccaatcggccctcaggacgtccctgaccgattctctggctccaagtctggcacctcagcctccctggccatcactgggctccaggctggaggatggaggctgattattactgccagtcgtatgacagcagcctgagttggtttgggtgttcgggcgga

SEQ ID NO: 785580 - DNA, 494 bp, Homo sapiens
  misc_feature: HIJSMM301BZIAM.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgctttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggct

SEQ ID NO: 785581 - DNA, 502 bp, Homo sapiens
  misc_feature: HIJSMM301A86LI.3.33.C11.1.454.light.4.raw
agacgcactccacgaccggtgctcgatttagagtgagctcgttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcgggcggtagggaccaagctgaccgtcctaggtcagcccaaggctgtccccccg

SEQ ID NO: 785582 - DNA, 499 bp, Homo sapiens
  misc_feature: HIJSMM301EDU95.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcaggtgggtctggggacagagttcactctcaccatcagcagcctgcagtctgaagattttgctagtttattactgtcagcagtataataactggttcctgctcactttacggcggggggtaccgaaggtggaggatcaaacgaactgtggctgcacatctgt

SEQ ID NO: 785583 - DNA, 511 bp, Homo sapiens
  misc_feature: HIJSMM301DRXEC.47.85.H08.1.454.light.4.raw
  modified_base (453)..(453): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaatctggcaacacggcctccctgaccatctctgggctcgagtctgaggacgaggctgattacttctgttgctcttgggcaactactggtcgtttgggtgttcggcggnggaccaagttgaccgtcaggtcagcccaaggctgccccctcggtcactctgttccccg

SEQ ID NO: 785584 - DNA, 522 bp, Homo sapiens
  misc_feature: HIJSMM301B6BZW.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcggacccctgcccgattctcaggctccctccttggggcaaagctgccctgacactgtctggtgtgcagcctgaggacgaggctgactattactgcctactctactttggtggtgctgtgctagttcggcgggagggaccaagctcgaccgttcttaagtcagcccaaggctcgccccctcggtccactctcgttcccaccctcctcgcttacg

SEQ ID NO: 785585 - DNA, 381 bp, Homo sapiens
  misc_feature: HIJSMM301BOU5R.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcacatctgtcttcatcttcccgcatctgaatagtataga

SEQ ID NO: 785586 - DNA, 500 bp, Homo sapiens
  misc_feature: HIJSMM301EKSDA.13.55.E11.1.454.light.4.raw
  modified_base (395)..(395): a, c, t, g, unknown or other
  modified_base (491)..(491): a, c, t, g, unknown or other
  modified_base (497)..(497): a, c, t, g, unknown or other
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattacngttctacaagatacacaattatactgggtacgtcggtcgaacgggaccaagggtacggaaagtacgaacgaaactaacgtagtcggtctgaccacnctactntct

SEQ ID NO: 785587 - DNA, 485 bp, Homo sapiens
  misc_feature: HIJSMM301CP2G7.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctcctccccctacattcgtcagggaccaagttgaacatcaatcgaactgtggctgcacc

SEQ ID NO: 785588 - DNA, 496 bp, Homo sapiens
  misc_feature: HIJSMM301API93.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtgggatccgagggcaggaggaccgaggctggactattattgtcaatcagcagacaacagtaatacttatctttatgtcttcggatctgggaccagggtcaccgtcctaggtcagcccaaggcccaaccccc

SEQ ID NO: 785589 - DNA, 520 bp, Homo sapiens
  misc_feature: HIJSMM301B0Q4F.43.23.C01.1.454.light.4.raw
  modified_base (448)..(448): a, c, t, g, unknown or other
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctccgtcgggggcaaagctgccctgacactgtcaggtgtgcagcctgaggacgaggctgactattactgcctgctcatatatggtggcgcgtgggtgttcggnggagggaccaagctgaccgtctgggtcacgcccaaggctgcccccgtcggtccactctcgttccccaccctt

SEQ ID NO: 785590 - DNA, 522 bp, Homo sapiens
  misc_feature: HIJSMM301D7ETX.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccccgactgtcactctcgttcccgccctcctcccgt

SEQ ID NO: 785591 - DNA, 527 bp, Homo sapiens
  misc_feature: HIJSMM301A2BIV.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcattatacaggggacagcatttagttttgggttggtttcgggcgggacgggaccaagctcgaccgtcctgcgtcacgcccaaggctcgccccctcggtcacttc

SEQ ID NO: 785592 - DNA, 514 bp, Homo sapiens
  misc_feature: HIJSMM301DSK7Q.7.34.D01.1.454.light.4.raw
cgtgtctctacacgaccggtgctcgatttagatcgtctgtggttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcatttatttgggtgttcggcggagggaccaagctgaccgtcctgcgtcagcccaaggctcgccccctggtcactt

SEQ ID NO: 785593 - DNA, 487 bp, Homo sapiens
  misc_feature: HIJSMM301AVN3U.48.51.E07.1.454.light.4.raw
agtatacatacacgaccggtgctcgatttagcatactctacaacacacaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcattagcagctatttaaattggtatcagcagaaaccagggaaagcccctaagctcctgatctatggtgcatccattttgcaaagtgggatcccatcagggttcagtggcagtgggtctgggacagatttcactctcaccatcagcagtttgcaacctgaagtattttgctaacttactactgtcaacagagttacagtcgacccgtacgtaattttcggaccgacggggaccaagctggagatacaaacgaact

SEQ ID NO: 785594 - DNA, 487 bp, Homo sapiens
  misc_feature: HIJSMM301DX0KI.46.35.D02.1.454.light.4.raw
  modified_base (476)..(476): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcaggtgggtctgggacagacttcactctcaccatcagcagactggagcctgaagattttgcagtctattactgtcagcagtatggtcacgtcccaagtaacttttggccaggggaccaagctggagatcaaacgactgnggctgcaccat

SEQ ID NO: 785595 - DNA, 523 bp, Homo sapiens
  misc_feature: HIJSMM301CGWZA.17.33.C11.1.454.light.4.raw
  modified_base (427)..(427): a, c, t, g, unknown or other
  modified_base (436)..(436): a, c, t, g, unknown or other
  modified_base (488)..(488): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaaacaacaaacactcctggacccctgcccgattctcaggctccctccttggggcaaagctgccctgacactgtctggtgtgcagcctgaggacgaggctgactattactgcctactctacttttggnggtgctgtnctattcggcggaagggaccaagctgaccgtcttaaggtcaggccccaaggcngccccctggtccactctcgttcccaccctccttcc

SEQ ID NO: 785596 - DNA, 518 bp, Homo sapiens
  misc_feature: HIJSMM301AMC53.9.53.E09.1.454.light.4.raw
tgatacgtctcacgaccggtgctcgatttagagagagtgtgttgggtttgggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtacttcgggcggacgggaccgaaggtgacccgtcctacggtcacgcccgaaggcctcggtcccccccg

SEQ ID NO: 785597 - DNA, 506 bp, Homo sapiens
  misc_feature: HIJSMM301DNEU9.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaagcccctaagctcctgatctatgctgcatccactttacaaaatggagtcccatcaagattcagcgcagtggatctggcacagctttcactctcaccgtcagcagcctgcagtctagtaagattttgactaactttattactgtctacaagattcttcttaccctcggacgttcggtccgacgggaccgacgggtcggtagtgtactaacgacgaacgtgtggtcgtcgtcaccgta

SEQ ID NO: 785598 - DNA, 498 bp, Homo sapiens
  misc_feature: HIJSMM301BD5YF.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtctaatacaacagacaccattggtacttatgtcttcggaactgcgaccaagtcacgtcctggtcagcccaaggcccaaccccactgtcactcttccg

SEQ ID NO: 785599 - DNA, 449 bp, Homo sapiens
  misc_feature: HIJSMM301CTP8A.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatggaggctgactattactgccagtcctatgacatgaggctgagtggttcgtatgtcttcggatctgggaccaaggtcaccgtcctaagtcagcccaaggcccaaccctctgtcactctcgttcccgccctcctccatactcgta

SEQ ID NO: 785600 - DNA, 460 bp, Homo sapiens
  misc_feature: HIJSMM301A7A3A.48.59.F04.1.454.light.4.raw
agtatacatacacgaccggtgctcgatttagtacacacacttagggattgggggctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtgctgcaccatctgtcttcatcttcccgcatctgatatgtatact

SEQ ID NO: 785601 - DNA, 444 bp, Homo sapiens
  misc_feature: HIJSMM301BL0BO.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccggtcctaggtcagcccaaggctgccccctcggtcactctgttcccaccctcctcagcgtatca

SEQ ID NO: 785602 - DNA, 495 bp, Homo sapiens
  misc_feature: HIJSMM301DU9AN.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactggaccaaggtcaccgtctaggtcagcccagga

SEQ ID NO: 785603 - DNA, 498 bp, Homo sapiens
  misc_feature: HIJSMM301DQQV7.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgctagtttattactgtcagcagtatgatacctggcctccgtacacttttcggccggggaccaaggctggaaatcaagcgaactgtgctgcaccatctgtcttcattcc

SEQ ID NO: 785604 - DNA, 504 bp, Homo sapiens
  misc_feature: HIJSMM301CBY81.9.67.G01.1.454.light.4.raw
tgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagattttgctagtttattactgtcagcactataatagttggccgctcactttcggcggtagggaccgaaggtggagctccaaacgaactgtggctgcaccatctgtcttcattccc

SEQ ID NO: 785605 - DNA, 518 bp, Homo sapiens
  misc_feature: HIJSMM301BV4QW.10.12.B01.1.454.light.4.raw
catagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagaggcccccagggatcccctgagcgattctctggctccagctcagggacaacagtgacgttgacatcagcggagcccgggcagaggacgaggctgactattactgtcaatcacaagactattactggtacttagttgggtgttcggcggacgggtccaagctcgaccgttcctaggtcagcccgaaggctcgcccccgttcggtcactcttcgttccccgt

SEQ ID NO: 785606 - DNA, 497 bp, Homo sapiens
  misc_feature: HIJSMM301CVFWO.15.25.C03.1.454.light.4.raw
tctacgtagccacgaccggtgctcgatttagtagtgtagatttgggtttgggggatcgaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctcggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaagaactgtggctgcaccat

SEQ ID NO: 785607 - DNA, 480 bp, Homo sapiens
  misc_feature: HIJSMM301C5LXK.21.25.C03.1.454.light.4.raw
  modified_base (353)..(353): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaactcctcatctatggtaacagcaatcggccctcaggggtccctgaccgattcnctggctccaagtctggcacctcagcctcctggtcatcgctgggctccaggctgacgatgaggctgattattattgccagtcctatgacaacaccctgcgtggttttggtctgttcggcggcgggacc

SEQ ID NO: 785608 - DNA, 485 bp, Homo sapiens
  misc_feature: HIJSMM301AO239.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggacacgactggagattaacgaactgtggctgacaccat

SEQ ID NO: 785609 - DNA, 508 bp, Homo sapiens
  misc_feature: HIJSMM301CPOYF.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaactacttggttttcggcggtacgggaccaagctcgaccgtcctaggtcacgcccaaggcctcgtccccccg

SEQ ID NO: 785610 - DNA, 513 bp, Homo sapiens
  misc_feature: HIJSMM301CVA6D.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactcgtggggacacagccactctgaccatccgcgggacccaggctgtggatgaggctgactattactgtcaggcggtgggacgagggaggctggcgtagttttcggcgggagggaccgagtctgaccgtcctaggtcagcccgaagcctcgccccctcggtccactcttcccg

SEQ ID NO: 785611 - DNA, 505 bp, Homo sapiens; identical to SEQ ID NO: 722292
  misc_feature: HIJSMM301BP4UH.21.81.H04.1.454.light.4.raw

SEQ ID NO: 785612 - DNA, 504 bp, Homo sapiens
  misc_feature: HIJSMM301CZ1FN.19.78.H01.1.454.light.4.raw
tactctcgtgcacgaccggtgctcgatttagtgtgagtagtttggggtttgggggtcacaagaggcagcgctctcgggacgtctccaccatggcctgggctctgctgctcctcactctcctcactcaggacacaggggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcgccctcaggggtttctaatcgcttctctggctccaagtctggcaacacggcctccctgacaatctctgggctccaggctgaggacgaggctgattactactgctgctcatatgcaggtcgtattctcttatgtcttcggaactgggaccaggtcaccgtctaggtcagcccaaggccaaccccactgtcta

SEQ ID NO: 785613 - DNA, 529 bp, Homo sapiens
  misc_feature: HIJSMM301EGQ3F.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtacaaacaacaaacactcctggacccctgcccgattctcaggctccctccttgggggcaaagctgccctgacactgtctggtgtgcagcctgaggacgagctgactattactgcctactcttactttggtggtgctgtgctattcggcggagggaccaagctcgaccgttcttaagtcagccccaaggcctcggccccctcggtccactctcgttccccaccctcccttacccg

SEQ ID NO: 785614 - DNA, 473 bp, Homo sapiens
  misc_feature: HIJSMM301BT34A.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacaaccactctgaccatcagcgggacccaggctatggatgaggctgactattactgtcaggcgtggacatcagcagtgaggtggtttcggcggagggaccaagctagaccgtcctaagtcag

SEQ ID NO: 785615 - DNA, 492 bp, Homo sapiens
  misc_feature: HIJSMM301A2KUQ.47.55.E11.1.454.light.4.raw
  modified_base (488)..(488): a, c, t, g, unknown or other
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaaagtcccacgaacggcccccaaactcctcatctataacaatgatcagcggccctcagggtccctggccgattctctggctccaagtctggcgcctcagccaccctggccatcagtgggctccggcccaaggatgaggctgattattactgtgtaggttgggatcgcagcctgactgcttacgtcttcggagctgggacaaggtcaccgtcctaggtctagcccaaggcctaacccactgtcactctcgttcccaccctcctctacgtnagct

SEQ ID NO: 785616 - DNA, 497 bp, Homo sapiens
  misc_feature: HIJSMM301A2R1S.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctactttattttgctgctcttatgcagcagtttcgctctcgagtgttcggcggagggaccgagctgaccgtcctacgtcagcccaaggctccg

SEQ ID NO: 785617 - DNA, 527 bp, Homo sapiens
  misc_feature: HIJSMM301BIG2M.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatactacaaccagtgacacgttcgggtgttcgggcgggacgggaccaggctgacccgtccgtaggtcacgcccaaggctcgccccctcggtcactctcgttccc

SEQ ID NO: 785618 - DNA, 506 bp, Homo sapiens
  misc_feature: HIJSMM301ARCMT.41.18.B07.1.454.light.4.raw
tctatactatcacgaccggtgctcgatttagtcgctgcgtaagggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacggaggctgacttattattgtcaagcagtagacagcagtggtccttatcgggtggttcggcgggggaccaagactcgacgtccgtaggtcagccaaggctcgccccctcggtcacctcttcg

SEQ ID NO: 785619 - DNA, 507 bp, Homo sapiens
  misc_feature: HIJSMM301AY4UJ.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctctcaggacgttcggccaagggaccaaaggtcggaaaatcgaaaaaccgaactgtggcttggcaccct

SEQ ID NO: 785620 - DNA, 512 bp, Homo sapiens
  misc_feature: HIJSMM301DN4FF.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgcctgacaatctctgggctccaggctgacgacgaggctgatttttactgctgctcatatgcaggtgatcacacttttatgttcgggactgggaccaaggtcaccgtcctaggtcagcccaaggccaaccccactgcactcttccg

SEQ ID NO: 785621 - DNA, 492 bp, Homo sapiens; identical to SEQ ID NO: 571741
  misc_feature: HIJSMM301AF9EW.15.3.A03.1.454.light.4.raw

SEQ ID NO: 785622 - DNA, 515 bp, Homo sapiens
  misc_feature: HIJSMM301AJNSW.47.85.H08.1.454.light.4.raw
  modified_base (455)..(455): a, c, t, g, unknown or other
  modified_base (503)..(503): a, c, t, g, unknown or other
agctcacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagccccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggngggaccaagttgacgtcctaggtcagccaaggctgccccctcggtacnctctgttccccg

SEQ ID NO: 785623 - DNA, 518 bp, Homo sapiens
  misc_feature: HIJSMM301DA4KK.18.78.H01.1.454.light.4.raw
  modified_base (445)..(445): a, c, t, g, unknown or other
tacgagtatgcacgaccggtgctcgatttagtgtgagtagtttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaaactcatgatttatgatgtcactaatcggccctcgaggggtttctaatcgcttctctggctccaagtctggcaacacggcctccctgaccatctctgggctccaggctgaggacgaggctagattattactgcagctcatatacaagcaaccancaactctctatgtcttcggaactgggaccaaggtccaccgtcctaggtcacggggacccaacggcccaacccc

SEQ ID NO: 785624 - DNA, 478 bp, Homo sapiens
  misc_feature: HIJSMM301DAKDC.2.82.H05.1.454.light.4.raw
acgctcgacacacgaccggtgctcgatttagtcgagctctctcgcgggggtgggtccaggaggcagaactctgggtgtctcaccatggcctggatccctctacttctccccctcttcactctctgcacaggctctgaggcctcctatgagctgacacagccaccgtcggtgtcagtgtccccaggacagacggccaggatcacctgctctggagatgcattgccagatcaatatgctaattggtaccagcagaagccaggccaggcccctgtgctggtgatatataaagacagtgagaggccctcgagggatccctgagcgattctctggctccagctcgagggacaacagtcacgttgaccatcagtggagtccaggcagaggatgaggctgactattactgtcaatcagcagacacagtggtaatgattatgtcttcggaactgggaccaaggtcaccgtctacggtcacgacccg

SEQ ID NO: 785625 - DNA, 483 bp, Homo sapiens
  misc_feature: HIJSMM301AUMHK.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggaggggaccaaggtgcagatacaaacgaactgtggct

SEQ ID NO: 785626 - DNA, 520 bp, Homo sapiens
  misc_feature: HIJSMM301BMUNI.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatccggccctccggcgtttctattcgctttctctggctccaagtctggcaacacggcctccctgaccatctctggactccagactgaggacgaggctgattattactgctgctcatatacaggggacagcattatttgggtgttacgggcggagggaccaagctgaccgtcctgcgtcagcccaaggcctcgccccctcggtcacttcc

SEQ ID NO: 785627 - DNA, 515 bp, Homo sapiens
  misc_feature: HIJSMM301BQVAJ.15.76.G10.1.454.light.4.raw
  modified_base (501)..(501): a, c, t, g, unknown or other
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctacttggtggtgctgtgctattcggcggagggaccaagctggaccgtcttaagtcagcccaaggcctcgccccctcggtcactctgtcccnccctcctcgctacg

SEQ ID NO: 785628 - DNA, 516 bp, Homo sapiens
  misc_feature: HIJSMM301BKG96.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattacctgctagttcctttaaattaggacgccactctcgttggtttcggcggaggcaccgaagtgaccgtcctcggtcacgcccgaaggcgtcgcccccctcggt

SEQ ID NO: 785629 - DNA, 515 bp, Homo sapiens
  misc_feature: HIJSMM301BZBDZ.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgagggatgaggctgattattactgtgcagcatgggatgacagcctgagtggtccttgggtgttcggcggagggaccaagctgaccgtcctaagtcagcccaaggctgccccctcggtcactctgttcccgcctcctcg

SEQ ID NO: 785630 - DNA, 504 bp, Homo sapiens
  misc_feature: HIJSMM301AY1N1.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattacttgtcagcaatactatagtcctcctctcacgttccggcggagggaccaaggtggagatcaaacgaactggtggctgcaccatctgtctt

SEQ ID NO: 785631 - DNA, 515 bp, Homo sapiens
  misc_feature: HIJSMM301EPA0Q.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttggtgttcggcggagggaccaagttgaccgtcctaggtcagcccaaggctcgccccctcggtcactctcgttccccg

SEQ ID NO: 785632 - DNA, 518 bp, Homo sapiens
  misc_feature: HIJSMM301BRA5L.17.33.C11.1.454.light.4.raw
cgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcgggagggaccaagctgaccgtcttaagtcagcccaaggctcgccccctcggtcactctcgttcccgccctcct

SEQ ID NO: 785633 - DNA, 482 bp, Homo sapiens
  misc_feature: HIJSMM301CQIJH.5.73.G07.1.454.light.4.raw
atcagacacgcacgaccggtgctcgatttagctctacgctcagggggaggaactgctcagttaggacccagacggaaccatggaagccccagcgcagcttctcttcctcctgctactctggctcccagataccactgggagaaatagtgatgacgcagtctccagccgccctgtctgtgtctccaggggaaagagcctccctctcgtgcagggccagtcagatgttagaatcaacttagcctggtaccagcagaaacctggccagcctcccaggcccctcatctatgctgcatccgccagggccactggtatcccagccaggttcagtggcagtgggtctgggacagacttcactctcaccatcagcagcctgcagtctgaagattttgctagtttattactgtcagcagtatgatgactggcctcagacgttcggccaagggaccaaggtaggaagtcaaacgaactagtggctgcaccat

SEQ ID NO: 785634 - DNA, 426 bp, Homo sapiens
  misc_feature: HIJSMM301EPR9V.9.25.C03.1.454.light.4.raw
tgatacgtctcacgaccggtgctcgatttagtagtgtagatttgggtttgggaacctatgaacattctgtcagtggcccctggaaagacggccagcataacctgtgagggagacaacattaaaacaaataatgtgcattggtaccagcagaagccaggccaggcccctgtcctggtcgtctttgatgatagtgaccggccctcagggatcccctgagcgattctctggctccaactctgggaacacggccaccctgaccatcagcgggtcgaagccggggatgaggccgactatttctgtcagctgtgggattctcatgatggtagtgggggaatcgttcggcggtagggccaggctgaccgtctaagtcagcccaaggctgccccctcggtcactctgttccccaccctccgtcagaccgtatca

SEQ ID NO: 785635 - DNA, 484 bp, Homo sapiens
  misc_feature: HIJSMM301D8LPV.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaagccaggccaggcccctgtggtggtgatatataaagacagtgagaggccctcagggatccctgagcgattctctggctccagctcagggacaacagtcacgttgaccatcagtggagtccaggcaggaggacgaggctgactattattgtcaatcagcagacaacagtaatacttatctttatgtcttcggatctgggaccagggtcaccgtcctaggcagcccaaggccaa

SEQ ID NO: 785636 - DNA, 466 bp, Homo sapiens
  misc_feature: HIJSMM301CO15Q.49.4.A04.1.454.light.4.raw
agtcgagagacacgaccggtgctcgatttagagtagtgatcaggggcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttacttcaccatcagcaggctgcagcctgaagatattgcaacatattaactgtcaacagtatgatcgcctcccgctcacgtttcgggcgggggaccgaaggtggagatcaagcgaactgtgg

SEQ ID NO: 785637 - DNA, 475 bp, Homo sapiens
  misc_feature: HIJSMM301B9BCC.48.28.C06.1.454.light.4.raw
agtatacatacacgaccggtgctcgatttagagctcacgtattgggtttgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggcctcaggtattcctgagcgattctctggctccagttctgggaacacagccactctgaccatcagcgggacccaggctatggatgaggctgactattactgtcaggcgtgggacgatcagcagtgaggtggttttcggcggaggaccgaagctgaccgtcctaagtcagccc

SEQ ID NO: 785638 - DNA, 513 bp, Homo sapiens
  misc_feature: HIJSMM301C9A1T.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcacaatcgtaccgagtggctccgggggccactttccgccgtcggaccaagtaggtatatcaaacgtaactagtaggtctcgcgaccactcctgtctt

SEQ ID NO: 785639 - DNA, 509 bp, Homo sapiens
  misc_feature: HIJSMM301DXCEH.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggagtgttgggtttattactgcatgcaaactacacacggccgctcactttcggcggagggaccgaaggtggagatacaaacgaactgtggctgcaccatctgtt

SEQ ID NO: 785640 - DNA, 501 bp, Homo sapiens
  misc_feature: HIJSMM301AED1I.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctcgccccctcggtccactctgttcccaccctcctctgtcgagcgt

SEQ ID NO: 785641 - DNA, 492 bp, Homo sapiens
  misc_feature: HIJSMM301AMQHE.9.1.A01.1.454.light.4.raw
  modified_base (477)..(477): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtgctgcaccatcngtctcatcttccccg

SEQ ID NO: 785642 - DNA, 484 bp, Homo sapiens
  misc_feature: HIJSMM301A2QBD.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgagggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgttggttttggtctgttcggtcggcgggac

SEQ ID NO: 785643 - DNA, 519 bp, Homo sapiens
  misc_feature: HIJSMM301DCLIQ.48.17.B06.1.454.light.4.raw
  modified_base (220)..(220): a, c, t, g, unknown or other
  modified_base (239)..(239): a, c, t, g, unknown or other
agtatacatacacgaccggtgctcgatttagtcgatagtgaagggggctggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccncctatgacattggaaaatntaaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgtattttcgggcggagggacctaagctgaccgtcctacgtcacgcccaaggctcgccccctcggtcacgtctcgtt

SEQ ID NO: 785644 - DNA, 507 bp, Homo sapiens; identical to SEQ ID NO: 669106
  misc_feature: HIJSMM301BT0OF.8.28.C06.1.454.light.4.raw

SEQ ID NO: 785645 - DNA, 494 bp, Homo sapiens
  misc_feature: HIJSMM301CNG36.9.1.A01.1.454.light.4.raw
  modified_base (484)..(484): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaaagggacacgactggagattaaaggaactgtggctgcacatctgtcttnatcttccccg

SEQ ID NO: 785646 - DNA, 536 bp, Homo sapiens
  misc_feature: HIJSMM301E2DAS.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcagggtttctcatcgcttttctggctccaagtctggcaacacggcctcctgaccatctctgggctccaggctgaggacgaggctgattatttctgcagctcatacacaaccggcaccactgtcgtggttttcggtggagggaccaagactcgaccgtccgtacggttcagcccgaaaggtccgtacgcccccctccgggtccacttcccg

SEQ ID NO: 785647 - DNA, 506 bp, Homo sapiens
  misc_feature: HIJSMM301D6Z0O.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccagcggtgacgtttggtcttttatgactatgtctcctggtaccaaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgatttattactgcaggtcatatacaatcagcaacacttatgtcttcgggactgggaccaagatcaccgtcctaggtcagcccaaggccaaccccactgtca

SEQ ID NO: 785648 - DNA, 501 bp, Homo sapiens
  misc_feature: HIJSMM301CFFJL.43.54.E10.1.454.light.4.raw
  modified_base (202)..(202): a, c, t, g, unknown or other
tgtgagtagtcacgaccggtgctcgatttagatcgtagcagaacacacaaagggggatcaggactcctcagttcaccttctcacaatgaggctccctgctcagctcctggggctgctaatgctctgggtcccaggatccattggggatattgtgctgactcagtctccactctccctctccgtcacccttggacagtcggtntccatctcctgcaggtctagtcacagcgtcctacacagtgatggaagaacctacttggattggtttcagcagaggccaggccaatctccaaggctcctaatttataaggtttctagtcgggactctggggtcccagacagattcagcggcagtgggtcaggcactgacttcacactgaaaatcagtagtgtggaggctgagatgttgccatttattactgtcatgcaagggacacactaggccgtacacttttggtccagggggacctaacgctggaggatacaaaacggaacctaggt

SEQ ID NO: 785649 - DNA, 503 bp, Homo sapiens
  misc_feature: HIJSMM301B18XP.52.37.D04.1.454.light.4.raw
cgcagtacgacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccctgtgttggtgatgtataagacactgagaggccctcagggatccctgagcgattctctggctccaggtcagggacaacggtcacattcggccatcagtggagtccaggcgagaggacgaggctgactattattgtcaatcaacagacaccattggtacttatgtcttcggaactgacgaccaaggtcaccgtacctcggtcagtcccaaggccaaccccactcgtcacttcc

SEQ ID NO: 785650 - DNA, 525 bp, Homo sapiens
  misc_feature: HIJSMM301CEUD3.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccccgtccggtctactctgtttcccgccct

SEQ ID NO: 785651 - DNA, 517 bp, Homo sapiens
  misc_feature: HIJSMM301ALQK4.47.85.H08.1.454.light.4.raw
agctcacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaatcataatttatgacgtcaatgttcgcccctcaggggtttctcatcgcttctctggctccaaatctggcaacacggcctccctgaccatctctgggctacgagtctgaggacgaggctgattacttctgttgcttcttgggcaactactgtcgtttgggtggttcggcggagggaccaagttgaccgtcctggtcagcccaaggctgccccctcggtcactctcgttccccg

SEQ ID NO: 785652 - DNA, 455 bp, Homo sapiens
  misc_feature: HIJSMM301E37TG.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccccaaactcgtcatctataatgacgctgagcggtccttaagggtccctgaccgattctctggcgagaggtctggcgcctcagcttccctcggccatcagagggctccagtctgaagatgaggctgattattactgtgcaatctgggatgacagtgtgaacggtccggttttcggcggagggaccaagctgaccgtcctagtcagcccaaggctgcccctcggtcactctgttcccgccctcctccacgtagagta

SEQ ID NO: 785653 - DNA, 385 bp, Homo sapiens
  misc_feature: HIJSMM301DOFHT.49.37.D04.1.454.light.4.raw
agtcgagagacacgaccggtgctcgatttagtagcatactgttgggtttggggtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 785654 - DNA, 465 bp, Homo sapiens
  misc_feature: HIJSMM301DXO0J.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagccctaagctcctgatctatgctgaatccactttgcaaagtgggtcccatcaaggttcagtgcagtggatctgggacagatttcactctaaccatcagcggtctgcaacctgaagattttgcaactcactactagtcaacagagtgacagcacgcctcacactttcggcggagggaccaaggtggagatacaaacgaa

SEQ ID NO: 785655 - DNA, 493 bp, Homo sapiens
  misc_feature: HIJSMM301CYAYM.43.34.D01.1.454.light.4.raw
tgtgagtagtcacgaccggtgctcgatttagatcgtctgtgttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtcacgcccaaggcccaaccccactgtcactctcgttccccaccctcctcactactcaca

SEQ ID NO: 785656 - DNA, 493 bp, Homo sapiens
  misc_feature: HIJSMM301CSGLX.5.47.E03.1.454.light.4.raw
atcagacacgcacgaccggtgctcgatttagactcgcgcacagagagaagggggaagagctgctcagttaggacccagagggaaccatggaaaccccagcgcagcatctcttcctcctgctactctggctcccagataccgccggagaaattgtgttgacgcagtctccaggcaccctgtctttgtctccaggagaaagagccaccctctcctgcagggccagtcagagtgttagcggcgactacttagcctggtaccagcagaaacctggccagactcccaggctcctcatctttggtgtatccagcagggccactggctatcccacgtaggttcagtggcagtgggtctgggacagacttcactctcaccatcagcagactggagcctgaagattttgcagtgtattactgtcagcagtatgggctctcacctttcactttcggcggagggccaaggtggagaacaaacgaactgtggctgcaccatctcg

SEQ ID NO: 785657 - DNA, 500 bp, Homo sapiens
  misc_feature: HIJSMM301DNTOW.47.64.F09.1.454.light.4.raw
  modified_base (495)..(495): a, c, t, g, unknown or other
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagcccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcgggagggaccgaggggtggagatcaaacgaactgtggctgcaccatctgtcttcnttccc

SEQ ID NO: 785658 - DNA, 512 bp, Homo sapiens
  misc_feature: HIJSMM301AL3CU.9.1.A01.1.454.light.4.raw
tgatacgtctcacgaccggtgctcgatttagacgtctcatcaagggaagggaaggggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctcctggtatcaacaacacccaggcaaagccccccaactcattattctgatgtcaacaatcggcccccagggatttctgatcgcttctctggctccaagtctggcaacacggcctccctgaccatctctgggctccgggctgaggacgtaggctcactattactgcagctcatatacaaccagcgacactcgtgttgttcggcggagggactagaactgaccgtcctaggtcagcccaaggcctcgccccctcggt

SEQ ID NO: 785659 - DNA, 509 bp, Homo sapiens
  misc_feature: HIJSMM301AFIZV.10.29.C07.1.454.light.4.raw
  modified_base (493)..(493): a, c, t, g, unknown or other
catagtagtgcacgaccggtgctcgatttagagtgctacgaaggggaaagggggggggtctcaggaggcagcgctctcgggacgtctccaccatggcctgggctctgctattcctcaccctcctcactcagggcacagggtcctgggccccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgccgtctaggtcagcccaaggcncgccccctcggtctac

SEQ ID NO: 785660 - DNA, 513 bp, Homo sapiens
  misc_feature: HIJSMM301ARHBD.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccgaaactacggaccgtccgtacggtcagcccaaggcctcgcccccttcc

SEQ ID NO: 785661 - DNA, 514 bp, Homo sapiens
  misc_feature: HIJSMM301ANLYR.16.46.E02.1.454.light.4.raw
tgtactactccacgaccggtgctcgatttagactcatctacagggaaaggggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggttccctgatcgcttctctgggtccaagtctggcaacacggcctccctgaccatctctgggctccaggctggaggacgaggctgattattactgcagcttatatacaggcaaacaatacttttgtcttcggaactgggaccaaggtcaaccgtctagtcagcccaaggccaaccccatgtacactctcg

SEQ ID NO: 785662 - DNA, 497 bp, Homo sapiens
  misc_feature: HIJSMM301BJDKD.4.33.C11.1.454.light.4.raw
  modified_base (407)..(407): a, c, t, g, unknown or other
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcacgcagaaaccaggacagcctctaagctgctcatttaccgggcagctaccgggaatccggggtccctgagcgattcagtggcaggcgggtctgggacagatttcactctcaccatcagcagcctggcaggctgaagntgtggcagtttatactgtcagcaatattctactactcctcggactttcggcggtacgggaccgaacggtgggagataccgaaacgaacgt

SEQ ID NO: 785663 - DNA, 506 bp, Homo sapiens
  misc_feature: HIJSMM301EXRY8.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccggggccgaggatgaggctgattattactgtgcaggatgggatgacaacctgggtgcttatctcttcggacctgggaccaaggtcaccgtccttggtcc

SEQ ID NO: 785664 - DNA, 517 bp, Homo sapiens
  misc_feature: HIJSMM301ARX2W.48.81.H04.1.454.light.4.raw
agtatacatacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtaaccatctcctgctctggaagtagttccaacattgggaataattatgtctcctggtatcagcaactcccaggaacacgcccccaaactcctcatttatgacaataataagcgaccctcaggaattcctgaccgattctctggctccaagtctggcacgtcagccaccctgggcatcaccggactccagactggggacgaggccgattattactgcggaacatgggataacagcccgagtggtggccgggtcgttcggcggagggaccaagctgaccgtcctacgtcagcccaaggctcgtcccccg

SEQ ID NO: 785665 - DNA, 498 bp, Homo sapiens
  misc_feature: HIJSMM301BD52Q.9.53.E09.1.454.light.4.raw
tgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgcccccaaactcatcatttatgaggtcactaagcggccctcaggggttttctattcgcttctctggctccaagtctgacaacaccggccctccctgacaatctctgggctccaggctgaggacgaggctgatttattactgctgctcatatgcagatgggtgacctacctcccgtggttagttcggcgggaggacaacggtgaccgtcctaggtcacg

SEQ ID NO: 785666 - DNA, 495 bp, Homo sapiens
  misc_feature: HIJSMM301BFD8I.5.57.F02.1.454.light.4.raw
atcagacacgcacgaccggtgctcgatttagctcgatatagttgggtttgggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatcgtccccaaccagattcagtggcaggagggtctgggacagacttcagtctcaccatcagcagcgtacagtctgaagacttggcagtttatactgtcaacaatgtggtcagtggcctcgaacgttcggcccgagggaccacagtggatatcaggcgaactgtcggctgcaccatctgtctt

SEQ ID NO: 785667 - DNA, 511 bp, Homo sapiens
  misc_feature: HIJSMM301AS0DZ.9.21.B10.1.454.light.4.raw
tgatacgtctcacgaccggtgctcgatttagtgtcgtcgcaagagaggagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactctttaatttatgaggtcactaagcggccctcaggggtttctggtcgcttctctgcctccaagtctggcaacacggcctccctgacaatctctgggctccagtctgacgacgaggctgattattactgcagctcatatgcagtttggttccttctttcaagatattcggcggagggaccaggctgaccgtcctgagtcagcccaaggctcgtccccccg

SEQ ID NO: 785668 - DNA, 516 bp, Homo sapiens
  misc_feature: HIJSMM301APR3H.41.30.C08.1.454.light.4.raw
tctatactatcacgaccggtgctcgatttagtctgacgtcaaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttacggactgggaccagggtccaccgtcctaggtcacgcccaaggccaaccccactgtcactctgtt

SEQ ID NO: 785669 - DNA, 303 bp, Homo sapiens
  misc_feature: HIJSMM301DG6IX.14.36.D03.1.454.light.4.raw
  modified_base (136)..(136): a, c, t, g, unknown or other
cgtctagtaccacgaccggtgctcgatttagctgcgtcacgatctctcgttggggggggtctcaggaggcagcgctctcaggacatctccaccatggcctgggctctgctgctcctcaccctctcactcaggcacngggtcctgggcccagtctgccctgactcagcctgcctcgtgtcgtgggtctcctggacagtcgatccaccatccgtcctgcactggaaccagtcagttgacgttggtggttatagtatgtctctggtaccaacaacaccaggcaaacgcccccaaactcatgattta

SEQ ID NO: 785670 - DNA, 514 bp, Homo sapiens
  misc_feature: HIJSMM301AFV4P.26.26.C04.1.454.light.4.raw
  modified_base (98)..(98): a, c, t, g, unknown or other
agactatactcacgaccggtgctcgatttagtctagcgactttgggtttggggctgatcaggactcctcagttcaccttctcacaatgaggctccctnctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccgaagggaccgaacggtaggaaagtacaaacgaaactagtggcgtcgcacccacttc

SEQ ID NO: 785671 - DNA, 517 bp, Homo sapiens
  misc_feature: HIJSMM301C9W7U.13.25.C03.1.454.light.4.raw
tcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggccccagagtcatcatttatggggggcaataggcggccgtcagggatttccactcgcttctctggctccaagtctggcaacacggcctccctgacaatctctggtctccaggctgaggacgaggctgcctattactgctgctcatatgcaggtttcttcgttggtggttccgttcggcgggagggtccaaaggtgaccgtcctaggtcagcccaaggctcgccccctcggctactcc

SEQ ID NO: 785672 - DNA, 490 bp, Homo sapiens
  misc_feature: HIJSMM301E2MUS.10.1.A01.1.454.light.4.raw
catagtagtgcacgaccggtgctcgatttagacgtctcatcagggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactagctcagcatgggacaccggccctcagtgcgtgggttttcggcggagggaccaagctgaccggtcctagggtcagaccccg

SEQ ID NO: 785673 - DNA, 519 bp, Homo sapiens
  misc_feature: HIJSMM301EEUU0.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctcgccccctcggtcactctcgttccccaccctcctccgagtacgtaca

SEQ ID NO: 785674 - DNA, 501 bp, Homo sapiens
  misc_feature: HIJSMM301EUUYX.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagcccaggttcagtggcagtgggtctgggacagacttcactctcaccatcaagcagcctagagcctgaagtattttgctagtttattactgtcagcagcgtagcaactggcctctcactttcggcggaggaccaaggtggagatacaaacgaactgtggctgcaccatcgtgttctt

SEQ ID NO: 785675 - DNA, 465 bp, Homo sapiens
  misc_feature: HIJSMM301BIMWC.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagccctccctgaccatcactggactcaagcctgaggacgaggctgactattactgttcagcatggacggcagcctcagtgaatgggtgttcggcggagggaccaaac

SEQ ID NO: 785676 - DNA, 487 bp, Homo sapiens
  misc_feature: HIJSMM301EWWFE.46.35.D02.1.454.light.4.raw
  modified_base (482)..(482): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttaggcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgnaccat

SEQ ID NO: 785677 - DNA, 510 bp, Homo sapiens
  misc_feature: HIJSMM301CRGB8.49.41.D08.1.454.light.4.raw
agtcgagagacacgaccggtgctcgatttagtcacgcgagaaagggaaaggggatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagacttattactttaccggagtactttcggccaaggggaccaagggtggaaatcaaacgaactgtggctgacaccatctgtcttcattccttcccgccact

SEQ ID NO: 785678 - DNA, 529 bp, Homo sapiens
  misc_feature: HIJSMM301BUX80.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgactacttgggtgttcggcgggacgggaccgaggctgaccgtcctaggtcagcccaacggctcgcccccgtcgtcgactctcgttcccaccct

SEQ ID NO: 785679 - DNA, 489 bp, Homo sapiens
  misc_feature: HIJSMM301B08FA.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacacagtaatacttatctttatgtcttcggatctgggaccagggtcaccgtcctaggtcagcccgaagcccaacccc

SEQ ID NO: 785680 - DNA, 532 bp, Homo sapiens
  misc_feature: HIJSMM301DK2GR.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggcgggagggaccaggctggaccgtcctagggtccagcccaaggctgcccccgtccggtccactctcgttcccgcccctt

SEQ ID NO: 785681 - DNA, 514 bp, Homo sapiens
  misc_feature: HIJSMM301E4G3S.43.59.F04.1.454.light.4.raw
  modified_base (503)..(503): a, c, t, g, unknown or other
tgtgagtagtcacgaccggtgctcgatttagtacacacactttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtgcagtgacgttggaacttatgaccatgtctcctggtaccaacaataccccaggcaaaagcccccaaactcttgatttatgatgtcacttatcggccctcaggggtttcttatcgcttctctggctccaagtctggcaacacggctccctgaccatctctgggctcaggctgaggacgaggctgattattactgcaacttcacttacaacgaccgacacttgcgtattcggcggcgggaccaagctgaccgtcctaggtcagcccaaggctgccccctggtcactcngttcccaccct

SEQ ID NO: 785682 - DNA, 453 bp, Homo sapiens
  misc_feature: HIJSMM301COCHG.40.76.G10.1.454.light.4.raw
  modified_base (411)..(411): a, c, t, g, unknown or other
tctagcgactcacgaccggtgctcgatttagtcactcatacagggggcagaagtctctctcagtcaggacacagcatggacatgagggtccctgctcagctcctgggactcctgctgctctggctcccaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaaagtatgacactgtcccgctcactttcggcggagggaccaaggtggagatgaaggactgngctgcaccatctgtcttcatctcccgcatctgagtcgctaga

SEQ ID NO: 785683 - DNA, 482 bp, Homo sapiens
  misc_feature: HIJSMM301ERX0F.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtgggtcccgtcaaggttcagtgcagtggatctggacagatttcactctcaccgtcagcagtctgcaacctgaagatttgcaacttactactgtcaacagagttacagtaccccctcactttcggcgagggaccaaggcgagatcagacgaactgtggctgcaccatctgtcttcta

SEQ ID NO: 785684 - DNA, 518 bp, Homo sapiens
  misc_feature: HIJSMM301A12S3.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaaatggatacaactatttggattggtacctgcagaagccagggcagtctccacagctcctgatctatttgggttctaatcgggcctccggggtccctgacaggttcagtcggcagtggatcaaggcacagattttacactgaaaatcagcagagtggaggctggaggatgttggggtttattactgcatgcaagctctactaaactccttacacttttcggacctacgggggaaccaaggctagggagaattcaaaacggtaacctaggttggcg

SEQ ID NO: 785685 - DNA, 506 bp, Homo sapiens
  misc_feature: HIJSMM301EKYL1.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccgacagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttaataacactatactattcggcggagggaccaagctgaccgtcctgcgtcagacccaaggcctcgccccctcggtcactt

SEQ ID NO: 785686 - DNA, 520 bp, Homo sapiens
  misc_feature: HIJSMM301AJEAI.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaaggccggggatggaggccgactattattgtcaggtgtggtatttcagttagtattcagttccgggggttttcggcgggagggaccaagctgaccgtcctaggtcagcccaggctcgccccctggtccactctcgttcccc

SEQ ID NO: 785687 - DNA, 518 bp, Homo sapiens
  misc_feature: HIJSMM301A21X3.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaataccaggcaaggcccccaaactcttgatttatgatgtctctaatcggccctccggcgtttctattcgctttctctggctccaagtctggcaacacggcctccctgaccatctctggactccagactgaggacgaggctgattattactgctgctcatatacaggggacagcattatttgggtgttcgggcggagggaccaagctgaccgtcctgcgtcagcccaaggctcgccccctcggtccacttccg

SEQ ID NO: 785688 - DNA, 503 bp, Homo sapiens
  misc_feature: HIJSMM301CDYBN.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggtcctgatcgggcctccggggtcctgacaggttcagtggcagtggatcaggcacagattttacgctgaaaatcagtagggtggaggctgaggataggttggggtttattactgcatgcaagttctacaaacttcctactacttttaggccaggggaccaagcgtaggagatacaaaacgaactgtggctgcaa

SEQ ID NO: 785689 - DNA, 498 bp, Homo sapiens
  misc_feature: HIJSMM301AJP3X.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattatgtcaatcaacagacaccattggtacttatgtcttcggaactgccgaccaaggtccaccgtcctgggtcagcccaacggccaacccactgtcactctccg

SEQ ID NO: 785690 - DNA, 521 bp, Homo sapiens
  misc_feature: HIJSMM301E0V2U.4.71.G05.1.454.light.4.raw
  modified_base (396)..(396): a, c, t, g, unknown or other
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaaagtcaggccaggccccaaaattggtcatctatgaagacgacaaacgaccctccgggatccctgagagattctctggctccagctcagggactatggccaccttgactaatcagtggggcccaagtgggaggatgaagntgactactactgtactcaatagagaacagtgattaatttctgggttgttcggcggagggaaccaaacgtagaccgtacctaggtcgaagcccgaaaggctgcccccctacggtcaccttctcgtt

SEQ ID NO: 785691 - DNA, 489 bp, Homo sapiens
  misc_feature: HIJSMM301C94AI.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctctactttcggccggagggaccaaggtggagatacaaacgaact

SEQ ID NO: 785692 - DNA, 460 bp, Homo sapiens; identical to SEQ ID NO: 539553
  misc_feature: HIJSMM301CBR5L.11.86.H09.1.454.light.4.raw

SEQ ID NO: 785693 - DNA, 490 bp, Homo sapiens
  misc_feature: HIJSMM301BB62Z.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgacgtcctgggtcagcccaaggctg

SEQ ID NO: 785694 - DNA, 503 bp, Homo sapiens
  misc_feature: HIJSMM301CL0MO.43.34.D01.1.454.light.4.raw
  modified_base (429)..(429): a, c, t, g, unknown or other
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctcctgacaatctctgggctccaggctgaggacgaggctgattattattgctgctcatatgcnggtagttacacttatgtacttcggaattgggacgtacggtcaccgtcctaggtcagcccaaggccaacccctac

SEQ ID NO: 785695 - DNA, 517 bp, Homo sapiens
  misc_feature: HIJSMM301D1EOM.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgcccctcaccatcacgggggcccaggcagacgatgaatgtgattatcactgcgtcctttatgtggggcgtggcattttgggtgtttcggcggagggaccaaactgaccgtcctaggtcagcccaaggctgccccctcggtcactctcg

SEQ ID NO: 785696 - DNA, 508 bp, Homo sapiens
  misc_feature: HIJSMM301BSNC0.43.82.H05.1.454.light.4.raw
tgtgagtagtcacgaccggtgctcgatttagtcgagctctctcgcgggcacgaccggtgctcgatttagtacacacacttagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggacaagctgaccgtctggtcacg

SEQ ID NO: 785697 - DNA, 496 bp, Homo sapiens
  misc_feature: HIJSMM301B37XJ.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtactcacaaaccttcggccaggggacacgactggagattaagcgaacgtagtggctgcaccatctgttctt

SEQ ID NO: 785698 - DNA, 491 bp, Homo sapiens
  misc_feature: HIJSMM301A57YG.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagaaaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtcgtgggacagagttcactctcaccatcaacagcctgcagtctgaagtattttgctagtttattactgtcagcagtatcataactggccgctcaccttcggccaagggacacgactggagattaaacgactgtggctgcaccatctgtt

SEQ ID NO: 785699 - DNA, 504 bp, Homo sapiens
  misc_feature: HIJSMM301D8QG9.12.82.H05.1.454.light.4.raw
atacgacgtacacgaccggtgctcgatttagtcgagctctctcgcgggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttagcagtgtattattgtcagcagtatggtagcgcaccgtactacttttggccgaggggtccaagctggagatgaaacgaactgtggctgcacatctgtcttcatcttccccg

SEQ ID NO: 785700 - DNA, 491 bp, Homo sapiens
  misc_feature: HIJSMM301BQPGS.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaagtggggtcccatcaaggttcagtggcgccggatctgggacagaattcactctcaccatcagcgggctccagtctgaggactctgctaacttattactgccaacaatatgattatttattctccagtcgttcggcaggggaccaaggtggaagtcgaagcgaactgtggctgcaccatctgtt

SEQ ID NO: 785701 - DNA, 519 bp, Homo sapiens
  misc_feature: HIJSMM301BD2CI.27.23.C01.1.454.light.4.raw
  modified_base (509)..(509): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggcactcngttcccgcct

SEQ ID NO: 785702 - DNA, 497 bp, Homo sapiens
  misc_feature: HIJSMM301A7F17.9.1.A01.1.454.light.4.raw
  modified_base (49)..(49): a, c, t, g, unknown or other
tgatacgtctcacgaccggtgctcgatttagacgtctcatcaggggganctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcagggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacggactgagattaaaggaactgtggcgtgcaccatctgtcgttcatcttccccg

SEQ ID NO: 785703 - DNA, 516 bp, Homo sapiens
  misc_feature: HIJSMM301B80Z5.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgcttcgttgggcaactactgttcggtttgggtggttcggcgggagggacctaagttggaccgtccgtaggtcagcccaaggctcgccccctcggtcactct

SEQ ID NO: 785704 - DNA, 405 bp, Homo sapiens
  misc_feature: HIJSMM301ASZPD.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaaccccactgtcactctgttcccaccctcctcctacagtgct

SEQ ID NO: 785705 - DNA, 495 bp, Homo sapiens
  misc_feature: HIJSMM301EV5QY.19.57.F02.1.454.light.4.raw
tactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaacccctagctcctgatctatggtgcatccacttttggaaagtggggtcccctcaaggttcagcggcagtggatctgggacagatttcactctcgccatcagcagcctgcagactgaagattttgctaacttatttttgtcaacaggcctaacacctttccccctcactttcggcggagggaccaaggtggagatcaagcgaactgtgcgtagcaccatctgtctt

SEQ ID NO: 785706 - DNA, 521 bp, Homo sapiens
  misc_feature: HIJSMM301A6CNK.47.23.C01.1.454.light.4.raw
agctcacgtacacgaccggtgctcgatttagtacacgtgattagggattggggctgggcctaaggaagcagcactggtggtgcctcagccatggcccggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagctaggttttcggcgggtgggaccaagctgaccgtcctaagtcagcccaaggctcgcccccgtacggtccactctgttccccta

SEQ ID NO: 785707 - DNA, 522 bp, Homo sapiens
  misc_feature: HIJSMM301BG1G0.5.86.H09.1.454.light.4.raw
  modified_base (266)..(266): a, c, t, g, unknown or other
atcagacacgcacgaccggtgctcgatttagtgctatagacttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctctggtaccaanaacatccaggcaaacgcccccaaactcgtgatttctgaggtcagtaagcggccctcaggggtccctgatcgcttctctggctccaagtctggcaacacggcctccctgaccgtctctgggctccagactgaggatgaggctgacttattactgcagctctatttgcgaggcagtccgtaatacttcgttcgggcggacgggaccaagctcgaccgtcctaggtcacgcccaaggctcgtccccctcggtcctaccg

SEQ ID NO: 785708 - DNA, 488 bp, Homo sapiens
  misc_feature: HIJSMM301CDLI0.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactagaaaatcagtagagtggaggctgaggatgttggtagtttattactgcatgcaagctctacaaactcctctcacttcggcggagggaccaaggtgagatacaaacgaactgt

SEQ ID NO: 785709 - DNA, 496 bp, Homo sapiens
  misc_feature: HIJSMM301ATQFQ.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaagtgggtcccttcaaggttcagtggcagtggatctgggacagatttcactctcaccatcagcagtctgcacctgaagtattttgctaacttactactgtacaacagagttacaactacccctcggcctctactttacggcgggtaagggaccgaagggtaggagacgtacaaacgaactgtggctgcacc

SEQ ID NO: 785710 - DNA, 504 bp, Homo sapiens
  misc_feature: HIJSMM301EXM3G.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttatcgacagacagcagtggtagtcgagggggtcgttcggcggagggacgaagctggaccgtcctgagtcagcccaaggcctcgccccctcggtccactcctcgtt

SEQ ID NO: 785711 - DNA, 525 bp, Homo sapiens
  misc_feature: HIJSMM301BC7V7.5.58.F03.1.454.light.4.raw
atcagacacgcacgaccggtgctcgatttagtctgatcgagaaggggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttataaccttgtctcctggtaccaacagcaaccaggcaaagcccccaaacttttggtttatcagggcaataagcggcctcaggggtttctaatcgcttctctggctccaagtctggcaacacggccgccctgacaatctctgggctccaggctgacgacgaggctgtatttttactgtctgctcatatgcgaggtgatctactactttttatggtttcggacgtcgggaccaaggtcaccgtcctaggtcacgccaacggcccaacccactgtcactcttccg

SEQ ID NO: 785712 - DNA, 453 bp, Homo sapiens
  misc_feature: HIJSMM301B4WD6.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctggatgacagtgtgaacggtccggttttcggcggagggaccaagctgaccgtcctaagtcagcgcaaggctcgcccctcggtcactctgttcccgccctcctccacgagagta

SEQ ID NO: 785713 - DNA, 513 bp, Homo sapiens
  misc_feature: HIJSMM301DJ6VH.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggctatttgggtgttcggcggagggaccaaactgaccgtcctaggtcagccaaggctcgccccctcggtcactctcgttcccaccctcctcgctacgtaga

SEQ ID NO: 785714 - DNA, 497 bp, Homo sapiens
  misc_feature: HIJSMM301BVHQX.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagttttttactgtcagcagtatagtaactggcctccgtacacttttggccaggggaccaagctaagaaatcaaacgaactgtggctgcaccatctgttcttca

SEQ ID NO: 785715 - DNA, 498 bp, Homo sapiens
  misc_feature: HIJSMM301BWUXM.22.86.H09.1.454.light.4.raw
  modified_base (478)..(478): a, c, t, g, unknown or other
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaggctcgccccctcggtcnctctcgtccccaccctcctc

SEQ ID NO: 785716 - DNA, 544 bp, Homo sapiens
  misc_feature: HIJSMM301A94YB.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaccttgacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcgggcggtaggggacccaaggtcctggacccgtacttaaaggtccaaggccccaaggcctcgcccccctcggtccaccttcctgttcccccacccttccctccc

SEQ ID NO: 785717 - DNA, 525 bp, Homo sapiens
  misc_feature: HIJSMM301CF37O.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctagaggacgaggctgattattattgtagttcatatacaaccagtgacacttgggtgttcgggcggagggaccaggctgaccgtcctaggtcacgcccaaggctcgccccctcggtcactctcgttcccaccct

SEQ ID NO: 785718 - DNA, 501 bp, Homo sapiens
  misc_feature: HIJSMM301BTOB9.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatggggctgattattactgtgtaggttgggatcgcagcctgactgcttacgtcttcggagctgggaccaaggtcaccgtcctagggcacgtgagactcagaaatgaccagagggagtgaatgagggtgcagagaactccatggctaccaggtcagcccaaggccaaccccactgtcactctgttcccaccctcctccta

SEQ ID NO: 785719 - DNA, 476 bp, Homo sapiens
  misc_feature: HIJSMM301CPBW3.12.1.A01.1.454.light.4.raw
  modified_base (401)..(401): a, c, t, g, unknown or other
  modified_base (446)..(446): a, c, t, g, unknown or other
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtccatcaaggttcagtggcagtgggtctgggacagattcactctcaccatcagcagtctgcaactgaagattctgcaacttattactgttcaacagngtaaacagttaccctccactttcggcggagggaccaaggtggagntacaaacgaactgtggctgcacactctgtt

SEQ ID NO: 785720 - DNA, 507 bp, Homo sapiens
  misc_feature: HIJSMM301AVRTP.51.83.H06.1.454.light.4.raw
  modified_base (493)..(493): a, c, t, g, unknown or other
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgctagtttattattgtcagcagcgaaacaactggcctccttggacgttcgccaagggacgaacggtggaaatacaaacgaacgtgtggctcgacaccattcncgtcttcattcccg

SEQ ID NO: 785721 - DNA, 529 bp, Homo sapiens
  misc_feature: HIJSMM301AI86X.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctcgtgggctccagtctgacgacggaggctgattattactgcagctcatatgcagttggttccttctttacaagattagttcgggcgggacgggaccgaggctcggacccgttcctggagtcacgccccgaaggcctccggtcccccccgg

SEQ ID NO: 785722 - DNA, 518 bp, Homo sapiens
  misc_feature: HIJSMM301C2H94.22.21.B10.1.454.light.4.raw
acatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcggggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccgaaggccgtcgccccccgtccggtcctactcttccg

SEQ ID NO: 785723 - DNA, 503 bp, Homo sapiens
  misc_feature: HIJSMM301A145Y.19.67.G01.1.454.light.4.raw
tactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaatttttgtgcagtggtaccagcagcgcccgggcagttcccccacattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctcgccccctc

SEQ ID NO: 785724 - DNA, 492 bp, Homo sapiens
  misc_feature: HIJSMM301EKDWD.16.86.H09.1.454.light.4.raw
  modified_base (450)..(450): a, c, t, g, unknown or other
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctgctccaagtctggcaacacggcctccctgaccatctctgggctccaggctgaggacgagggtgattattactgcagctcatatagaagtggcagcactctcgtnttcggcggtgggaccaagctgaccgtctaggtcagcccaagg

SEQ ID NO: 785725 - DNA, 506 bp, Homo sapiens
  misc_feature: HIJSMM301A0RBA.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcacccatcaatagaccctggaagctgaagatgctgcaacttatactgtcatcagagtactactttacctacaagtgatcaccttcggccaagggacacgactggagattaaacg

SEQ ID NO: 785726 - DNA, 343 bp, Homo sapiens
  misc_feature: HIJSMM301CSEY0.17.28.C06.1.454.light.4.raw
cgtagactagcacgaccggtgctcgatttagagctcacgtattgggtttgggaacctatgaacattctgtaggggccactgtcttccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttccccaccctcctcctagtctacg

SEQ ID NO: 785727 - DNA, 386 bp, Homo sapiens
  misc_feature: HIJSMM301CG7RK.48.38.D05.1.454.light.4.raw
agtatacatacacgaccggtgctcgatttagtatctgatagttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 785728 - DNA, 416 bp, Homo sapiens
  misc_feature: HIJSMM301CN5VL.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaagtacttttgtcttcggaactgggaccaaggtcaccgtcctaggtcagcccaaggccaaccccactgtcactctttcccgccctcctcgagtagtaca

SEQ ID NO: 785729 - DNA, 471 bp, Homo sapiens
  misc_feature: HIJSMM301AWFEK.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggcctgggactgagtagcatatgaagagaactgtcgg

SEQ ID NO: 785730 - DNA, 521 bp, Homo sapiens
  misc_feature: HIJSMM301E0XMJ.17.33.C11.1.454.light.4.raw
cgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtacaaacaacaaacactcctggacccctcgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgcccccttcggtcactctcgttcccgccctcctccc

SEQ ID NO: 785731 - DNA, 456 bp, Homo sapiens
  misc_feature: HIJSMM301A5IA3.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcgggcggagggacaagctgaccgtcctaagtcagcgcaagctcgccccctcggtcactctcgttccccgccctcctccacgagagta

SEQ ID NO: 785732 - DNA, 501 bp, Homo sapiens
  misc_feature: HIJSMM301AHDD1.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacaggagttcactctcaccatcagcagcctgcagtctgaagtattttgctagtttattactgtcagcagtataattactggcctcggacgttcggtccgaacggaccgaacggtaggaagtacaacgaactagtggctgcacactctgtctt

SEQ ID NO: 785733 - DNA, 509 bp, Homo sapiens
  misc_feature: HIJSMM301CRMNS.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcactagtgcttactatccaaactggttccagcagaaacctggacaagcacccagggcactcatttatagtacaaacaacaaacactcctggacccctgcccgattctcaggctccctccttgggggcaaagctgctctgacactgtctggtgtgcagcctgaggacgaggctgactattactgcctactcttactttggtggtgctgtgctattcggcggagggaccaagctgaccgtcttaagtcacgcccaaggcctcgccccctcggtcactctgtt

SEQ ID NO: 785734 - DNA, 504 bp, Homo sapiens
  misc_feature: HIJSMM301DVP1X.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgtttggtggttacgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctggctccaggctgaggatgaggctgattattactgcagctcatatgcaggcagcagcagtccccatcgtgatcttcggcggggggaccaagctcgaccgtcctaggtcgagcccaacg

SEQ ID NO: 785735 - DNA, 497 bp, Homo sapiens
  misc_feature: HIJSMM301AG8E0.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggcctcctcatctatgatgcatccaacagggccactggcactcccagacaggttcagtggcaggtgggtctgggacagacttcactctcaccatcagcagcctagagcctgaagtactttggactttattactgtcagcagcgtgagttctggcctccgctcacgtttcggcggtagggaccagggtggagatacaacgaacgtgtggctgcaccatctgtcttc

SEQ ID NO: 785736 - DNA, 477 bp, Homo sapiens
  misc_feature: HIJSMM301AILI7.52.59.F04.1.454.light.4.raw
cgcagtacgacacgaccggtgctcgatttagtacacacacttagggattggggaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgtgctaacttatttctgtcataactatgatgatcgcccctcacgacgttcggccgaagggaccaagctaggaaatacaaacgaactg

SEQ ID NO: 785737 - DNA, 494 bp, Homo sapiens
  misc_feature: HIJSMM301DQG8V.22.14.B03.1.454.light.4.raw
  modified_base (472)..(472): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtactgggacagatttcactctcaccatcagcagcctgcaggctgaagatgtggcagtttatattgtcagcaatatatattcctctcagacgttcggccaagggccaaggtgaaatnaaacgactgtaggctgcaccta

SEQ ID NO: 785738 - DNA, 509 bp, Homo sapiens
  misc_feature: HIJSMM301EQT5D.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtccccccggacagacagccaccatcagctgctctggagatgtcttgactaatgagtatgcttcctggtatcagcagaaggcaggccagccccctgtcctactcatctttcaaaataccaggcgccctctgggtccctgagcgattctccggctccggctctgggacacagtcactctgaccatcagcgggacccaggctattgatgaggctgtctacttctgtcaggcgtgggacaacagcgtggtgttcgggcggtaggggaccacgtctcgtacccgtcgttacggtcagcccctaaggcctacgccccccgtcggtccgacttccg

SEQ ID NO: 785739 - DNA, 505 bp, Homo sapiens
  misc_feature: HIJSMM301DZZH7.43.53.E09.1.454.light.4.raw
tgtgagtagtcacgaccggtgctcgatttagagagagtgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttatgagggcactaagcggccctcaggggtttctgatcgcttctctggctccaagtctggcaacacggcctccctgacaatctctgggctccaggctgaggacgaggctgatttattattgctgctcatatgcaggtagttacacttatgttcttcggaattgggacgacggtcaccgtcctaggtcagcccaaggcccaaccccac

SEQ ID NO: 785740 - DNA, 506 bp, Homo sapiens
  misc_feature: HIJSMM301B9SJD.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgtcttctctggctccaagtctggcaacacggcctccctgaccatctctgggctccaggctgatgacgaggctgattattactgcaggtcatatacaatcagcaacacttatgtcgttcgggactgggaccaagatcaccgtcctaggtcagcccaaggccaaccccactgtcta

SEQ ID NO: 785741 - DNA, 524 bp, Homo sapiens
  misc_feature: HIJSMM301BN8XW.40.35.D02.1.454.light.4.raw
tctagcgactcacgaccggtgctcgatttagcacacgatagttgggtttgggggtagagaagacaggattcaggacaatctccagcatggccggcttcccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccgaagctgaccggtccctaggtcagcccaaggctgccccctcggtcactctgttcccaccctcctc

SEQ ID NO: 785742 - DNA, 507 bp, Homo sapiens
  misc_feature: HIJSMM301B7DQU.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggaggaccaagctgaccgtcctaggtcagcccaaggctcggccccctcggtctacc

SEQ ID NO: 785743 - DNA, 512 bp, Homo sapiens
  misc_feature: HIJSMM301ASGC8.48.31.C09.1.454.light.4.raw
  modified_base (480)..(480): a, c, t, g, unknown or other
agtatacatacacgaccggtgctcgatttagacgtctcatcaaggaaggaagggggtcaggctggaactgaggagcaggtgggggcacttctccctctaacactctccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagtattttcggctcaccatcagcagtctacaacctgaagtattttgcaacctacttctgtcaccaggcttacaacttccccctccgacgtcgccaacggaccgaaggtaggagtanagacgaactgtggctgcaccatctgtcttcta

SEQ ID NO: 785744 - DNA, 492 bp, Homo sapiens
  misc_feature: HIJSMM301DV5PK.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgatttgcaacttactactgccaagtgcataataatctatttcggcggagggaccgaaggtggagatacaaacgaactgtggctgcaccatctgtcttcattcccg

SEQ ID NO: 785745 - DNA, 486 bp, Homo sapiens
  misc_feature: HIJSMM301DVQ82.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggcctcccaggctcctcatctatggtgcatccagcagggccactggcatcccagacaggttcagtggcaggtgggtctgggacagacttcactctcaccatcagcagactggagcctgaagtattttgcagtgtattactgtcagcagtatggtagctcacctcggacgttcggccaagggaccaaggtaggaaatacaaacgaactagtggctg

SEQ ID NO: 785746 - DNA, 494 bp, Homo sapiens
  misc_feature: HIJSMM301DY7XX.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaagaactagt

SEQ ID NO: 785747 - DNA, 488 bp, Homo sapiens
  misc_feature: HIJSMM301AHM1B.47.78.H01.1.454.light.4.raw
  modified_base (486)..(486): a, c, t, g, unknown or other
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagctgagtagtgtggttttcggcgggagggaccaaactcgaccgtcctaggtcagcccaaggctgccccctcggtcactctgttccccaccctcctcctacgtganct

SEQ ID NO: 785748 - DNA, 498 bp, Homo sapiens; identical to SEQ ID NO: 535295
  misc_feature: HIJSMM301A2621.15.25.C03.1.454.light.4.raw

SEQ ID NO: 785749 - DNA, 497 bp, Homo sapiens
  misc_feature: HIJSMM301BSCZ8.48.33.C11.1.454.light.4.raw
agtatacatacacgaccggtgctcgatttagagtgagctcgttgggtttgggggggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaaagtcaattttggttttggtatcagcagaagtcaggccaggccccaagactgctcatgtatagagacagtgagaggtcctcagggatccctgagcgattctctggctccagctctgggacacactcactctgactatcagtgaagtccgggcagaagacgaggctgactactattgtcagtcaggagacaatactcgcacgcaacggtactggttcggcggaagggaccaagcgtgacagtccgtaggtcagcccaaggcgtgccccctc

SEQ ID NO: 785750 - DNA, 488 bp, Homo sapiens
  misc_feature: HIJSMM301D1GW0.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgttcttcggatctagggaccagggtcaccggtctaggtcagcccaaggccaacccc

SEQ ID NO: 785751 - DNA, 505 bp, Homo sapiens
  misc_feature: HIJSMM301A2E1H.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctcgccccctcggcta

SEQ ID NO: 785752 - DNA, 523 bp, Homo sapiens
  misc_feature: HIJSMM301COEQ9.12.28.C06.1.454.light.4.raw
  modified_base (412)..(412): a, c, t, g, unknown or other
  modified_base (440)..(440): a, c, t, g, unknown or other
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtgcagtggatctgggacacaattcactctcaccatcgctgatctgcagcctgaagattttgcacttactactgtcaacanagttctagtgtcccccggtccgtgtcgnggaccggacgacgtagaagtataacgaggtacacgtaggtacgtcgcgacgactactcttcgtcttactccttaccttccccg

SEQ ID NO: 785753 - DNA, 455 bp, Homo sapiens
  misc_feature: HIJSMM301B56OX.19.86.H09.1.454.light.4.raw
  modified_base (447)..(447): a, c, t, g, unknown or other
tactctcgtgcacgaccggtgctcgatttagtgctatagacttgggtttgggggccgttcctgggcccagtctgtgctgactcaggcaccctcagcgtctgggacccccgggaagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcgggcggagggaccaagctgaccgtcctaagtcagcgcaaggctgccccctcggtcactctgttcccgccctcctccncgagagta

SEQ ID NO: 785754 - DNA, 503 bp, Homo sapiens
  misc_feature: HIJSMM301E05CI.19.71.G05.1.454.light.4.raw
  modified_base (158)..(158): a, c, t, g, unknown or other
  modified_base (494)..(494): a, c, t, g, unknown or other
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccngtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatactttcgtaggtacgttcggccaagggaccgaaggtggatagtcaagagaactcgnggtcgtgca

SEQ ID NO: 785755 - DNA, 502 bp, Homo sapiens
  misc_feature: HIJSMM301D52EY.41.35.D02.1.454.light.4.raw
tctatactatcacgaccggtgctcgatttagcacacgatagctgggtttgggggaaaaggccctgaggaagacaaaccccagctgtgaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgacctcaggctcagtctctcctagtaattacgccagctggtaccagcagaccccaggccagcctccacgcatcctcatctactacacggacactcggtcttctggggtccctgatcgcttctctggctccatccttgggaacaaagctgccctcaccatcacggggcccaggcagatgatgaatctgattattactgtgcgctatttgtgtataacgtcaattgggtcttttggcggtagggaccaacg

SEQ ID NO: 785756 - DNA, 508 bp, Homo sapiens
  misc_feature: HIJSMM301DPOM6.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatgaaaactacttagcttggtaccagcagagaccaggacagcctcctaggctgctcatttactgggcatctacccgggaatccggggtccctgaccgattcagtggcagcgggtctgggacagattcactctcaccatcagcagcctgcaggctgaagatgtggctagtttattattgtcaacaatattattatactttcgtggtacgttcggcctaagggaccaaggtggtagtatactagacgaacctagtggtcgtcgctaa

SEQ ID NO: 785757 - DNA, 494 bp, Homo sapiens
  misc_feature: HIJSMM301AXLAO.5.34.D01.1.454.light.4.raw
  modified_base (417)..(417): a, c, t, g, unknown or other
atcagacacgcacgaccggtgctcgatttagatcgtctgtgttggggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcgcagtggatcgtgggacagatttcactctcaccatcagcagcctgcagcctggaatattttgcaactttactattgtcaacnggactaacagtttcccctccgaccttccggccaacgggacacgactggagattaaacgactagtggctagccacgta

SEQ ID NO: 785758 - DNA, 522 bp, Homo sapiens
  misc_feature: HIJSMM301DSBEI.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaaggccggggatgaggccgactattactgtcaggtgtgggatagtagtcgtgagcatgtggtattcgggggcgagggaccaactcgaccgtcctaggtcagcccaaggctcgccccctcggtccactctcgttcccccg

SEQ ID NO: 785759 - DNA, 515 bp, Homo sapiens
  misc_feature: HIJSMM301DEANY.41.53.E09.1.454.light.4.raw
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccgaggctgaggacgaggctgatttattactgcagctcaatactacaagcaggagcacctcgttcgtggtattcgggcggaagggaccaagcgtcgaccgtcctaggtccagcccaaggcctccg

SEQ ID NO: 785760 - DNA, 490 bp, Homo sapiens
  misc_feature: HIJSMM301AYEO9.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccgaaggaccgaaggtggaactacaaacgaac

SEQ ID NO: 785761 - DNA, 510 bp, Homo sapiens
  misc_feature: HIJSMM301BM4HO.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggggcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtacgagtggccgtccgggggccactttcggccctgggtaccaaaggtggagtatcaaacgaactcgtggctgcaccatctgtctt

SEQ ID NO: 785762 - DNA, 441 bp, Homo sapiens; identical to SEQ ID NO: 534971
  misc_feature: HIJSMM301DQOQR.11.3.A03.1.454.light.4.raw

SEQ ID NO: 785763 - DNA, 513 bp, Homo sapiens
  misc_feature: HIJSMM301AKSSC.40.23.C01.1.454.light.4.raw
tctagcgactcacgaccggtgctcgatttagtacacgtgattagggattgggcacgaccggtgctcgatttagtacacgtgattagggattgggggaggaactgctcagttaggacccagagggaaccatggaagcccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtggtctgggacagacttcactctcaccatcagcggcctagagcctgaagactttgctagtttattactgtcagcacgcgtaccaactcggccgctcacgtttcggcggagggaccaagggtggagagtac

SEQ ID NO: 785764 - DNA, 516 bp, Homo sapiens
  misc_feature: HIJSMM301AR6JP.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcgaggggtttctaatcgcttctctggctccaagtctggcaacacggccctccctgacaatctctgggctccaggctggaggacggaggctgattactactcgctgctcatatgcgaggtcgtatcttcttattgtcttcggaactgggaaccaacggccaccgtcctaggtcagcccaacggcccaaccccactgtcta

SEQ ID NO: 785765 - DNA, 523 bp, Homo sapiens
  misc_feature: HIJSMM301DDEYD.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagagtgttggcgcctacgtagcctggtaccaacagaaacctggccaggctcccacggcccctcatctatggtgcatccaacagggccactggcactcccagccaggttcagtggcagtgggtctgggacagacttcactctcaccatcatcagcctggagcctgaagatgttgctagtttattactgtcaacatcgtaccgagtggcccgtccgggggcctaccgtttccggtcccgtcgggaccaaaggtggatatacaaacgaactggtcggctgcaccatctcgtctt

SEQ ID NO: 785766 - DNA, 490 bp, Homo sapiens
  misc_feature: HIJSMM301EWYTG.49.81.H04.1.454.light.4.raw
agtcgagagacacgaccggtgctcgatttagtagtgtagattcgcggggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgttattttactttcaccatcatcaacctgcagcctgaggatattgcaacatattactgtcaacaatatgataatctaccactctactttcggcggagggaccgacgggtaggagatcaaacgaactgtgctgcaccatctgtt

SEQ ID NO: 785767 - DNA, 516 bp, Homo sapiens
  misc_feature: HIJSMM301BPF6J.41.56.F01.1.454.light.4.raw
tctatactatcacgaccggtgctcgatttagcagacgtctgaacacacaaaggggggggtcacaagaggcagcgctctcgggacgtctccaccatggcctgggctctgctgctcctcactctcctcactcaggacacagggtcctgggcccagtctgccctgactcagcctgactccgtgtctgggtctcctggacagtcgatcaccatctcctgcactggaaccacagtgatgttgggaattataaccttgtctcctggtaccaacaccacccaggcaaagcccccaaactcataatttatgagggcagtaagcggccctcaggggtttctaatcgcttctctggctccaagtctggcaacacggcctccctgacaatctctggactccaggctgaggacgaggctgattattactgctgctcatatgcaggtagtagggagttgggtggttcggcggagggaccgaagctcgaccgtccgtgggtcagcccaaggctcgccccctcggtctacc

SEQ ID NO: 785768 - DNA, 497 bp, Homo sapiens
  misc_feature: HIJSMM301AX3ZC.48.43.D10.1.454.light.4.raw
agtatacatacacgaccggtgctcgatttagactagcagtaagggggctggtcacacttcttgcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtgggccccatcgaggttcagcggcagtggatcagggacagagttcactctcaccatcagcagcctgcagcctgaagattttgctaacttattactgtacaaccactttaacaacttaccctcataagccgttcggccgaaggacccgaggtacggaaaccgaacgacgaacct

SEQ ID NO: 785769 - DNA, 486 bp, Homo sapiens
  misc_feature: HIJSMM301ARE3T.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcgggtagggaccgaagcgtcgaccgtccgtaagtcgagacccg

SEQ ID NO: 785770 - DNA, 516 bp, Homo sapiens
  misc_feature: HIJSMM301E3FDF.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagtctttgtcttcggaagtggaccaaggtcaccgtctaagtcagcccaacggccaaacccccactcgtacactcctgttccccacccctcccg

SEQ ID NO: 785771 - DNA, 496 bp, Homo sapiens
  misc_feature: HIJSMM301AIOC0.47.64.F09.1.454.light.4.raw
agctcacgtacacgaccggtgctcgatttagcgcgtatacaagggggaggaactgctcagttaggaccccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggagggaccagggtggagatcaaacgaactgtggctgcaccatctgtcttcatcc

SEQ ID NO: 785772 - DNA, 504 bp, Homo sapiens
  misc_feature: HIJSMM301DSK9O.8.28.C06.1.454.light.4.raw
  modified_base (485)..(485): a, c, t, g, unknown or other
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccntctgtcttcatcttcccgc

SEQ ID NO: 785773 - DNA, 509 bp, Homo sapiens
  misc_feature: HIJSMM301BOOGQ.48.34.D01.1.454.light.4.raw
agtatacatacacgaccggtgctcgatttagatcgtctgtgttggggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctcccaggctcctcatttatgatacatccaccagggccactggtgtcccagccaggttcactgggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcattcttcccgccta

SEQ ID NO: 785774 - DNA, 450 bp, Homo sapiens
  misc_feature: HIJSMM301AS4WV.18.9.A09.1.454.light.4.raw
  modified_base (417)..(417): a, c, t, g, unknown or other
tacgagtatgcacgaccggtgctcgatttagcgagacgcgcagggtcctgggcccagtctgtgctgacgcagcccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatggaggctgactattactgccagtcctatgacatgaggctgagtggttcgtatgtcttcggatctgggaccaaggtcaaccgtcctaagtcagcccaaggccaacccctcngtcactctgttcccaccctcctccatactcgta

SEQ ID NO: 785775 - DNA, 495 bp, Homo sapiens
  misc_feature: HIJSMM301AY4CS.19.5.A05.1.454.light.4.raw
tactctcgtgcacgaccggtgctcgatttagatagatagacaggcagggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagtatttcactctcaccatcagcagcctgcaggctgaagatgtggcggtctattactgtcaacaatattatgaagtccaggacgtttcgccgtggtacgaaggtggagatacgagacgtaacgtagtggcgtgccacaactctgttcttacta

SEQ ID NO: 785776 - DNA, 498 bp, Homo sapiens
  misc_feature: HIJSMM301CAP0R.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttatacttgtcagcagcgtgccaactggcctctcacgttcggcgagggaccaggtggacatcaacactagtggctgcaccatctgtcttcatcttcccg

SEQ ID NO: 785777 - DNA, 362 bp, Homo sapiens
  misc_feature: HIJSMM301D55DI.3.57.F02.1.454.light.4.raw
agacgcactccacgaccggtgctcgatttagctcgatatagttgggtttgaggggtgtggtggtctccactcccgccttgacggggctgctatctgccttccaggcccctatcctggtcatcaattatgacagcgacccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaaccaaggctggcccctcggtcactctgttcccaccctcctcgagtgcgtct

SEQ ID NO: 785778 - DNA, 502 bp, Homo sapiens
  misc_feature: HIJSMM301APYK2.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccacctttgactatcactgggacccagatggacgatgaaaggtgactaccactgttattcgacagacagcagtggtaggtcagggggtcttcgggcggagggacgaaggctggaccgtcctgagtcagcccaaggctgccccctcggtcactc

SEQ ID NO: 785779 - DNA, 524 bp, Homo sapiens
  misc_feature: HIJSMM301EJLI0.48.45.E01.1.454.light.4.raw
agtatacatacacgaccggtgctcgatttagtgagtcagtaagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggagtagtagtagtgatcatcctaattgggtgttcggcggagggaccaagctgaccgtcctaggtcagcccaaggctcgccccctcggtccactctcgttcccaccctt

SEQ ID NO: 785780 - DNA, 499 bp, Homo sapiens
  misc_feature: HIJSMM301EULNG.51.81.H04.1.454.light.4.raw
cgatcgtatacacgaccggtgctcgatttagtagtgtagattcgcggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttaattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcgaactgcgaccaagtcaccgtcctggtcagcccaaggcccaaaccccactgtcactcttccg

SEQ ID NO: 785781 - DNA, 527 bp, Homo sapiens
  misc_feature: HIJSMM301C9T30.41.30.C08.1.454.light.4.raw
tctatactatcacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggccaaacccccaaagtcatcatttatgatgtcggtagtcggccctccggggtctctagtcgcttctctggctccaagtctggcaacacggcctccctgacagtctctcggctcccaggcggaggacgaggctgattactactgcttctcatatgcagatactaagtcctgggtgttcggacgggagggaccaagctgaccgtcctaggtccagcccaaggctcgccccctcggtcactctgttcccccg

SEQ ID NO: 785782 - DNA, 529 bp, Homo sapiens
  misc_feature: HIJSMM301CQOTJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttcgtcgggtcgttcggccgaacgggaaccgaaggtaggaaagtacaaacgtaacctaggtggctcgtccaccgtactctgttcttctacttccttcccccg

SEQ ID NO: 785783 - DNA, 505 bp, Homo sapiens
  misc_feature: HIJSMM301C7D96.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggtttataaacactatactattcggcggagggaccaagctgaccgtcctgctcagccaacggctcgccccctcggtcacttc

SEQ ID NO: 785784 - DNA, 526 bp, Homo sapiens
  misc_feature: HIJSMM301CYECO.52.46.E02.1.454.light.4.raw
  modified_base (435)..(435): a, c, t, g, unknown or other
cgcagtacgacacgaccggtgctcgatttagactcatctacaggggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaagtccccaaaactcatgatctttgaggtcaatgatcggcccgcaggggtttctcatcgcttctccggctccaagtctggcagcacggcctccctgaccatctctgggctccaggctgaggacgaggctgattatactgcagctcatatacaaacanaaacaacttaggtgttcggtcggcgggaccagactgaaccggtcctaccggtcagcccaacggctcggccccctccggtcacctcttccgg

SEQ ID NO: 785785 - DNA, 476 bp, Homo sapiens
  misc_feature: HIJSMM301CCMK6.7.81.H04.1.454.light.4.raw
  modified_base (323)..(323): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagnttcagtggcagtggatctgggacagatttcactctcgccatcagtagtctgcaacctgatgattttgcaacttactactgtcaacagagtccactaccccaatctactttcggccctgggactgaacgtgcatatgaagagaactgtgctgca

SEQ ID NO: 785786 - DNA, 538 bp, Homo sapiens
  misc_feature: HIJSMM301EH58I.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgccgtacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaagtccggggtccctgaccgattcagtggcagcgggtcgtgggacagatttcactctcaccatcagcagcctgcaggctagaagatgtggctagtttattactgtcaaactgttttcgtcgggcggtcgtaccgaacgggacgaacggtaggaagtacgaaaccgaaactggtaggtcgtcgcgtaccaactcttagttctttactacttccctttccccg

SEQ ID NO: 785787 - DNA, 490 bp, Homo sapiens
  misc_feature: HIJSMM301DT7XS.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaaggttgagatcaaacgaactgtggctgcaccta

SEQ ID NO: 785788 - DNA, 509 bp, Homo sapiens
  misc_feature: HIJSMM301ETZ8G.3.33.C11.1.454.light.4.raw
agacgcactccacgaccggtgctcgatttagagtgagctcgttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccagacaaagcccccaaactcatgatttatgaggtcacaaagcggccctcaggggtccctgatcgcttctctgcctccaagtctggcaacaccggcctccctgaccgtctctgggctccagcctgaggatgaggctgattattactgcagctcatatgcaggcaatcaactacttggttttcgggcggtagggaccaagctcgaccgtcctaggtcagcccaaggctcgtccccccg

SEQ ID NO: 785789 - DNA, 478 bp, Homo sapiens
  misc_feature: HIJSMM301AP6I0.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatcgtgggacagatttcactctcaccatcagacagcctgcagcctgagattttgcaacttactattgtcaacaggctaacagttttcccttattacttcggccaaggacacgactggagattaaacgaactgtgg

SEQ ID NO: 785790 - DNA, 514 bp, Homo sapiens
  misc_feature: HIJSMM301BVFSM.22.36.D03.1.454.light.4.raw
acatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattacggcgccactctcgtggttttcggcggaggcaccgagtgaccgtcctcgtcagcccaaggctcgccccctcggtcact

SEQ ID NO: 785791 - DNA, 527 bp, Homo sapiens
  misc_feature: HIJSMM301AJL1A.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcgggagggaccaggctgaccgttcctaggtcacgcccaaggctcgccccctcggtcactctcgttcccaccct

SEQ ID NO: 785792 - DNA, 466 bp, Homo sapiens
  misc_feature: HIJSMM301CXNXE.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccagtggcctccgggggccactttcggccctgggaccaaagtggagatcaaacgaactgtggctgtcaccatcctgtcttcatcttcccgccactctgacactactattg

SEQ ID NO: 785793 - DNA, 471 bp, Homo sapiens
  misc_feature: HIJSMM301D7WRK.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccagtgccacttttggcggggggaccaaggtggacatcaaacgaa

SEQ ID NO: 785794 - DNA, 522 bp, Homo sapiens; identical to SEQ ID NO: 638532
  misc_feature: HIJSMM301AZMAF.27.23.C01.1.454.light.4.raw

SEQ ID NO: 785795 - DNA, 490 bp, Homo sapiens
  misc_feature: HIJSMM301A1QZY.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtgggcagtgggtctgggacagacttcactctcaccatcagcagactggagcctgaagattttgcagtctattactgtcagcagtatggtcaccgtcccaagaacttttggccaggggaccaagctggagatacaaacgaactgtggctgacaccat

SEQ ID NO: 785796 - DNA, 447 bp, Homo sapiens; identical to SEQ ID NO: 535201
  misc_feature: HIJSMM301ECAPU.18.9.A09.1.454.light.4.raw

SEQ ID NO: 785797 - DNA, 514 bp, Homo sapiens
  misc_feature: HIJSMM301AHQ4C.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgtttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacactttttaggccaggggacccaggtggagatcagactgatattaacagcgaaaagagaattttgttaagggaaagtaatgaagttaa

SEQ ID NO: 785798 - DNA, 518 bp, Homo sapiens
  misc_feature: HIJSMM301AJPRK.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtccactctgttcccgccctcctccc

SEQ ID NO: 785799 - DNA, 484 bp, Homo sapiens
  misc_feature: HIJSMM301AKRQF.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagtattttgctagtctatctattgtcagcagtataattggtggcctcggacgttcggccgacggaccgaaggtaggaatacaaacgaactagtggc

SEQ ID NO: 785800 - DNA, 527 bp, Homo sapiens
  misc_feature: HIJSMM301BXIWF.27.23.C01.1.454.light.4.raw
  modified_base (227)..(227): a, c, t, g, unknown or other
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgngatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggtcggagggaccgaggcgtgaccgtcctaggtcagcccaaggctgccccctcggtcactctcgttcccgccct

SEQ ID NO: 785801 - DNA, 479 bp, Homo sapiens
  misc_feature: HIJSMM301CAUUJ.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctccaggctcctcctctatgatgcatccaccagggccactggtatcccagccaggttcagtggcagtgggtctgggacagagttcactctcaccatcagcagcctgcagtctgaggatattgctagtttattactgtcagcagtatactaactggcctctgacgttcggccaagggaccagggtggaaatcaaacgaactgtgctcgcaccat

SEQ ID NO: 785802 - DNA, 513 bp, Homo sapiens
  misc_feature: HIJSMM301DZC79.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacggaggctgatttattactgcaggtcatatacaatcaagcaacacttatgttcttcgggactgggaccaagatcaccgtcctaggtcacgcccaacggacccaaccccactcgtcta

SEQ ID NO: 785803 - DNA, 488 bp, Homo sapiens
  misc_feature: HIJSMM301D5JNH.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggcaacgggaccaaggtggatatcagacgaacgt

SEQ ID NO: 785804 - DNA, 495 bp, Homo sapiens
  misc_feature: HIJSMM301BYCWR.51.12.B01.1.454.light.4.raw
cgatcgtatacacgaccggtgctcgatttagtagtgtagattccgcgggcacgaccggtgctcgatttagtcgagctctctcgcgggcacgaccggtgctcgatttagcacacgatagttgggtttggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacacg

SEQ ID NO: 785805 - DNA, 508 bp, Homo sapiens
  misc_feature: HIJSMM301AG8QP.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagtattttgctagtttattactgtcagcagcgtagcaacctccctctacgttcggcggagggaccgaaggtggagatacaaacgaactagtggctgcaccatctgtcttcatccttcccgtcactcg

SEQ ID NO: 785806 - DNA, 507 bp, Homo sapiens
  misc_feature: HIJSMM301BK7WY.9.71.G05.1.454.light.4.raw
tgatacgtctcacgaccggtgctcgatttagtgtcgtcgcaagagagaggggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgagctgattattactgcagctcatatgcagttggttcctctttcaagattattcgggcggagggaccaggctgaccgtcctgagtcagcccaaggctcgccccccg

SEQ ID NO: 785807 - DNA, 506 bp, Homo sapiens
  misc_feature: HIJSMM301BK9CB.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagtattttgctctgtatcactgtcagcaatatggtggtacacccctcactttcggcggaggggccaggtggagatcaagcgaactgtggctgcaccatctgtcttcatcttcccgcc

SEQ ID NO: 785808 - DNA, 517 bp, Homo sapiens
  misc_feature: HIJSMM301APR14.43.67.G01.1.454.light.4.raw
  modified_base (453)..(453): a, c, t, g, unknown or other
tgtgagtagtcacgaccggtgctcgatttagagtatacatattggggtttggggcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttcccagcacaaaccagggcagcctccaaagctgctcatttacttgggatctacccgggaatccggggtccctgaccgattccgtggcaggcgggtctgggacagtactcactctcaccatcagtagcctgcagcctgaaagntgtggacacttatactgtcaataatttcgtatactccgccgacgtcggtccgggaccgaccgta

SEQ ID NO: 785809 - DNA, 506 bp, Homo sapiens; identical to SEQ ID NO: 565590
  misc_feature: HIJSMM301BYJ4R.4.71.G05.1.454.light.4.raw

SEQ ID NO: 785810 - DNA, 504 bp, Homo sapiens
  misc_feature: HIJSMM301BXFZ2.19.10.A10.1.454.light.4.raw
tactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatcccccgacaggttcagtggcagtgtgtctgggacagacttcactctcaccatcagcagactggagcctgaagatttgcagtgtattactgtcaacgatatgatgagtcacctccgtggtggacatttggccaggggaccaaggttgaagtacaaacgaactgtggctgcaccatctgtcttcatcttccccg

SEQ ID NO: 785811 - DNA, 518 bp, Homo sapiens
  misc_feature: HIJSMM301DRCSP.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgtttcgggcggagggaccaagctgaccgtcctgcgtcacgcccaaggctcgccccctcggtcacttcc

SEQ ID NO: 785812 - DNA, 521 bp, Homo sapiens
  misc_feature: HIJSMM301AEHKZ.17.87.H10.1.454.light.4.raw
cgtagactagcacgaccggtgctcgatttagcagtactgcgttggggtttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggtaggcaccgaaggtagaccggtcctacggtctagcccaacggcgtcgccccctccggtccgta

SEQ ID NO: 785813 - DNA, 511 bp, Homo sapiens
  misc_feature: HIJSMM301DXUAJ.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcacctttcggcccggggaccaaaggtggaaatacaaacgaactgtggctgcaccatctgtcttcatccttcccgcc

SEQ ID NO: 785814 - DNA, 511 bp, Homo sapiens; identical to SEQ ID NO: 641509
  misc_feature: HIJSMM301ASEKL.40.81.H04.1.454.light.4.raw

SEQ ID NO: 785815 - DNA, 483 bp, Homo sapiens; identical to SEQ ID NO: 609812
  misc_feature: HIJSMM301DOFJJ.46.35.D02.1.454.light.4.raw

SEQ ID NO: 785816 - DNA, 503 bp, Homo sapiens
  misc_feature: HIJSMM301AD7VR.49.68.G02.1.454.light.4.raw
agtcgagagacacgaccggtgctcgatttagtcgatagtgaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgttcttcggaactgcgaccaaggtcaccgtacctgggtcacggcccaaggcccaacccccactgtcta

SEQ ID NO: 785817 - DNA, 501 bp, Homo sapiens
  misc_feature: HIJSMM301BXSBV.4.33.C11.1.454.light.4.raw
agcactgtagcacgaccggtgctcgatttagagtgagctcggttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtgggcagtttattactgtcagcgaatattctactaactcctcggactttcggcggtagggacccaaggtggtagacgtactaaacgaacttac

SEQ ID NO: 785818 - DNA, 464 bp, Homo sapiens
  misc_feature: HIJSMM301AMLA8.22.28.C06.1.454.light.4.raw
acatacgcgtcacgaccggtgctcgatttagagctcacgtattggggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtggttcggcggagggacctaggctgaccgtcctaggtcacgcccaaggctgccccctcggtcactctgttcccaccctcctcacgcgtatgt

SEQ ID NO: 785819 - DNA, 512 bp, Homo sapiens
  misc_feature: HIJSMM301EK40D.5.60.F05.1.454.light.4.raw
atcagacacgcacgaccggtgctcgatttagtacgtcatcagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgacccgattctctggctccaagtctggcacctcagcctccctggccatccgtgggctccagtctgaggatgagtctgattattactgttgcaacatgggatgacagcctgaatggtccggtagttcggcggagggaccaagctgaccgtctcggtcagccaaggctcgccccctcggt

SEQ ID NO: 785820 - DNA, 500 bp, Homo sapiens
  misc_feature: HIJSMM301CN0I8.52.78.H01.1.454.light.4.raw
cgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcaggaggacgaggctgactattactgttcaatcaacagacagtagtggttacttatgtgcaggttcggcggagggaccaagctgaccgtctaggtcagccaagctcgccccctcggt

SEQ ID NO: 785821 - DNA, 501 bp, Homo sapiens
  misc_feature: HIJSMM301D3HSZ.4.68.G02.1.454.light.4.raw
agcactgtagcacgaccggtgctcgatttagtcgatagtgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacattggtggttataactatgtctcctggtaccagcaatacccaggcaaagcccccaaactcatcgtttatgatgtcactgatcgggccctcaggggtttctagtcgcttctctggctccaagtctggcaacacggcctccctgaccatctctgggctccaggctgaggacgaggctgattattactgcagctcatatacaagcagcagcactcgtgggggtattcgggcggagggaccaaggctgaccgtcctaggtcagcccaaggctcc

SEQ ID NO: 785822 - DNA, 510 bp, Homo sapiens
  misc_feature: HIJSMM301AGUSD.51.69.G03.1.454.light.4.raw
cgatcgtatacacgaccggtgctcgatttagtcgctgcgtaaaggagaaaggggacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaccttatgatgtacactggtaccaacaacttccaggagcagcccccaaactcctcatctttggtaacaacaatcggccctcgaggggtccctgaccgattctctggctccaggtctggcacctcagcctccctggccatcactgggctccgaggctgaggatgagggtgattattactgccagtcctatgacagcggcctcagttatttgggtggtggttcggcggagggaccaaggtcgaccgtcctaagtcagcccaaggctcgccccctcggt

SEQ ID NO: 785823 - DNA, 511 bp, Homo sapiens
  misc_feature: HIJSMM301BZXUQ.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacaccaggcaaagcccccaaactcatgatttttgaggtcaataagcggcctcaggggtccctgatcgcttctcaggctccaagtctggcaacacggcctccctgaccgtctctgggctccagactgaggatgaggctgattattactgcagctcatattcaggcagcaacagggtattcggcggagggaccaaggtgaccgtcctaggtcagcccaaggctgccccctcggtcactctcgttcccgccctcccg

SEQ ID NO: 785824 - DNA, 503 bp, Homo sapiens
  misc_feature: HIJSMM301D895R.19.85.H08.1.454.light.4.raw
  modified_base (297)..(297): a, c, t, g, unknown or other
tactctcgtgcacgaccggtgctcgatttagtatcactcagtcgcggggtccaaacagagcttcagcaagcatagtgggaatctgcaccatgccctgggctctgctcctcctgaccctcatcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacnggaatgacaaccggccctcaaaccatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggt

SEQ ID NO: 785825 - DNA, 516 bp, Homo sapiens
  misc_feature: HIJSMM301DT7OF.48.17.B06.1.454.light.4.raw
  modified_base (480)..(480): a, c, t, g, unknown or other
agtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaacgcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgtatttcggcggagggaccaagctgaccgtcctacgtcngcccaaggctcgccccctcggtccactctcgttccc

SEQ ID NO: 785826 - DNA, 507 bp, Homo sapiens
  misc_feature: HIJSMM301EBKOL.3.33.C11.1.454.light.4.raw
agacgcactccacgaccggtgctcgatttagagtgagctcgttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgacggtatgaggctgtattattactgcagctcatatgcaggcatcaactactgttttcggcggaggaccaagctgaccgtcctaacggtcacgcccaagctcgtccccccg

SEQ ID NO: 785827 - DNA, 512 bp, Homo sapiens
  misc_feature: HIJSMM301BVCNX.15.34.D01.1.454.light.4.raw
  modified_base (408)..(408): a, c, t, g, unknown or other
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatntgattatcactgcgtcctttatgtgggcgtggcatttggtgttcggcggagggacaaactagaccgtcctaaggtcagcccacggactgccccctcggtcgact

SEQ ID NO: 785828 - DNA, 484 bp, Homo sapiens
  misc_feature: HIJSMM301CD45S.51.81.H04.1.454.light.4.raw
  modified_base (231)..(231): a, c, t, g, unknown or other
  modified_base (482)..(482): a, c, t, g, unknown or other
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccctgagcgattctctggctccaggtcagggacaacgggtcacattggccatcagtggagtccaggcagaggacgaggctgactattattgtcgaatcaaacagacaccattggtacttatgtcttcgaactgcgacaaggtcacgtcctggtcagcccaaggccaacccnct

SEQ ID NO: 785829 - DNA, 515 bp, Homo sapiens
  misc_feature: HIJSMM301CQE7K.43.59.F04.1.454.light.4.raw
tgtgagtagtcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacgcctccctgaccatctctgggctccaggctgaggacgaggctgattattactgcaactcacttacaacgaccgacacttgcgtattcggcggcgggaccaagctgaccgtcctacggtcagcccaaggcctgccccctcggtcactctgtt

SEQ ID NO: 785830 - DNA, 384 bp, Homo sapiens
  misc_feature: HIJSMM301DDWBX.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggacggagggaccaaggtggagatcaaacgaactgtggctgcaccatctgtcttcatcttcccgccatctgaatagtataga

SEQ ID NO: 785831 - DNA, 486 bp, Homo sapiens
  misc_feature: HIJSMM301BV4MD.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctaccgggaaattggggtccctgtccgattcagcggcagcgtgtctgggacagatttcactctcaccatcagcagcctgcaggctgaagatgtggcggtctattactgtcaacaatatatgaaagtcagggactttcggccctgggactaaggtggagatcgagacgaactgtggctgcaccgatctcgttcttcta

SEQ ID NO: 785832 - DNA, 470 bp, Homo sapiens
  misc_feature: HIJSMM301AJUFH.41.48.E04.1.454.light.4.raw
tctatactatcacgaccggtgctcgatttagagagcgtcacagagagaaggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcgggagggaccgaagctgaccgtcct

SEQ ID NO: 785833 - DNA, 496 bp, Homo sapiens
  misc_feature: HIJSMM301EH99A.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtgggtcccatcaaggttcagcggcactggatctgggacagaattcactctcaccatcaacagcctgcagcctgatgatttggcaacttactactgccaaccgtatagtactttattcggtcaccttcggaccaagggacacgactggagattaaacgaactgtggctgcaccatctgtcttcatt

SEQ ID NO: 785834 - DNA, 499 bp, Homo sapiens
  misc_feature: HIJSMM301A04LL.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaacccttcggccaggggacacgactggagattaagcgaactagtggctggcacccatctgtcttt

SEQ ID NO: 785835 - DNA, 531 bp, Homo sapiens
  misc_feature: HIJSMM301BR6J9.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacgttgggtggttcgggcgggagggaccgaggcgtgaccgtcctagggtcagcccaaggctcgccccctcggtccactctcgttcccaccct

SEQ ID NO: 785836 - DNA, 513 bp, Homo sapiens
  misc_feature: HIJSMM301BY4P2.15.59.F04.1.454.light.4.raw
tctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcgggtcttcgggcggaggggaccaaggctgaccgtcctaggtcagccccaagctcgcccccctcggt

SEQ ID NO: 785837 - DNA, 499 bp, Homo sapiens
  misc_feature: HIJSMM301C9QED.43.20.B09.1.454.light.4.raw
tgtgagtagtcacgaccggtgctcgatttagtgtagtgtgaagggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatgatgcatccagcagggccactggcactcccagacaggttcagtggcagtgggtctgggacagacttcactctcaccatcagcagactggagcctgaagattttgcagtgtattactgtcaccagtatggtagctcacctaagacgttcggccaagggaccgaaggtggaaatcgaaaacgacgtagtggacgtgcaccatctgtcttcta

SEQ ID NO: 785838 - DNA, 508 bp, Homo sapiens
  misc_feature: HIJSMM301DZ83X.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcagggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaacggctgaccgtcctaggtcagcccaaggctcgcccccc

SEQ ID NO: 785839 - DNA, 475 bp, Homo sapiens
  misc_feature: HIJSMM301BVGXP.49.27.C05.1.454.light.4.raw
agtcgagagacacgaccggtgctcgatttagacgcgatcgaagggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcacctgatgatttgctaacttattattgtcaacagagttacagttactcccgttactacgttttggccgaggggaccaggctggactatacagacgaa

SEQ ID NO: 785840 - DNA, 506 bp, Homo sapiens
  misc_feature: HIJSMM301AIANQ.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccagttgaccgtctaggtcagccaaggctcgccccctcggtcactc

SEQ ID NO: 785841 - DNA, 481 bp, Homo sapiens
  misc_feature: HIJSMM301EZXPS.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtgcagtggatctgggacaaatttcactctcaccatcaatagcctgcaggctgaagatgtggcagcttattattgtcagcaatattatacttctcttccgatctacttttggccaggggaccaggctggagatcagacgaactgt

SEQ ID NO: 785842 - DNA, 542 bp, Homo sapiens
  misc_feature: HIJSMM301CFA7R.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgttcgtttgggtgttcgggtcgggacgggaccaaggttcgtaccgtccgttaggttccacggccccgaaagggcctcggccccccgtcgggtccaccttccttcggttta

SEQ ID NO: 785843 - DNA, 499 bp, Homo sapiens
  misc_feature: HIJSMM301B15Q6.16.78.H01.1.454.light.4.raw
  modified_base (119)..(119): a, c, t, g, unknown or other
  modified_base (376)..(376): a, c, t, g, unknown or other
tgtactactccacgaccggtgctcgatttagtgtgagtagtttgggtttgggggaggaactgctcagttaggacccagacggaaccatggaagccccagcgcagcttctcttcctcctnctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcancctgcagtctgaagtattttgtcggtttattactgtcagcagtataataatggcctccacggtacacttttggcctaggggaccaagctggagatcaaacgaactgtggctgcaccatctgtt

SEQ ID NO: 785844 - DNA, 532 bp, Homo sapiens
  misc_feature: HIJSMM301BMBI8.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttatgagggcactaagcggccctcgaggggtttctgatcgcttctctggctccaagtctggcaacacggcctcctgacaatctctgggctccgaggctggaggacgaggctgattattattgctgctcatatgctaggttacgttactactttatcgttcttacgggaattggggaccgacgggtccaacccggttccttaggtccacggacccaacggccccaaaccccctac

SEQ ID NO: 785845 - DNA, 511 bp, Homo sapiens
  misc_feature: HIJSMM301D56XV.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagcccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccgaaagtggaaattcaaacgaacgtgtggctgcaaccatctgtcttcatctcccgcc

SEQ ID NO: 785846 - DNA, 514 bp, Homo sapiens
  misc_feature: HIJSMM301DSS1S.41.35.D02.1.454.light.4.raw
tctatactatcacgaccggtgctcgatttagcacacgatagttgggtttgggggggggtcacaagaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcgggcggagggaccaagctgaccgtcctaggtcagcccaaggcctgccccctcggtcacttcc

SEQ ID NO: 785847 - DNA, 481 bp, Homo sapiens
  misc_feature: HIJSMM301AEA3L.40.83.H06.1.454.light.4.raw
  modified_base (44)..(44): a, c, t, g, unknown or other
tctagcgactcacgaccggtgctcgatttagatcacgtgcgtcncgggaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaagtgggtggttcggcgggacgggaaccaaactgtccgtcctaggtc

SEQ ID NO: 785848 - DNA, 502 bp, Homo sapiens
  misc_feature: HIJSMM301BQFYP.41.18.B07.1.454.light.4.raw
tctatactatcacgaccggtgctcgatttagtcgctgcgtaaggggggtgtgggtccaggaggcagaactctgggtgtctcaccatggcctggatcccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcggggggaccgaagctgaccgtcctaggtcagcccaaggctcgcccctcggtcactctcg

SEQ ID NO: 785849 - DNA, 490 bp, Homo sapiens
  misc_feature: HIJSMM301BFFP3.40.57.F02.1.454.light.4.raw
  modified_base (456)..(456): a, c, t, g, unknown or other
tctagcgactcacgaccggtgctcgatttagctcgatatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcgaggggtcgctgatcgcttctctggctccaagtctggcgacacggcctcctgaccatctctgggctccagactgaggatgaggctacttattttgctgctcttatgcaggcagttcgctctcgaagtgttcggnggagggaccgagctgaccgtcctacgtcacgccc

SEQ ID NO: 785850 - DNA, 516 bp, Homo sapiens
  misc_feature: HIJSMM301AHMVW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggtcgttcggccgaacgggaccaggtaggaaagtactaaacgaactcgtaggcgtgcaccatctagtcttctacttcttccccg

SEQ ID NO: 785851 - DNA, 493 bp, Homo sapiens
  misc_feature: HIJSMM301CEHV3.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggctagtttattactgtcagcagtattatactactctctgacgttggccaagggaccaaggtggagatcaaacgaactgtggctgcaccat

SEQ ID NO: 785852 - DNA, 506 bp, Homo sapiens
  misc_feature: HIJSMM301AJVPR.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggctccctgaccgtctctgggctccagactgaggatgaggctgactattactgcagctcattttgcaggcagccgtatacctcttcggcggagggaccaagctgaccgtcctaggtcagcccaaggctgccccctcggtcacc

SEQ ID NO: 785853 - DNA, 511 bp, Homo sapiens
  misc_feature: HIJSMM301CF8W9.43.12.B01.1.454.light.4.raw
tgtgagtagtcacgaccggtgctcgatttagtagtgtagattccgcgggggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagacccctaaactcctgatctatgctgcatccaggttgcagagtggggtcccatcaagattcagcggcagtggatctgggacagatttcactctcactatcagcagcctgccagcctgaagattttgccacttactattgtcaacaggctgacacgttttcccctttcctaccttcggtcccgaacgggaaccgacgaaccgtaggacgtaattaaaacgtaaacgtagtggctggccaccatta

SEQ ID NO: 785854 - DNA, 502 bp, Homo sapiens
  misc_feature: HIJSMM301BVXNO.48.69.G03.1.454.light.4.raw
agtatacatacacgaccggtgctcgatttagtcgctgcgtaaaggagaaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcaggtgggtctgggacagacttcactctcaccgtcagcagactggaccctgaagattttgcagtgtattactgtcagcagtatggtagctcaccgatcaccgttcggccaagggacacgactggagagttaaccgaactgtggctgcaccactctgtcttc

SEQ ID NO: 785855 - DNA, 507 bp, Homo sapiens
  misc_feature: HIJSMM301D8ZAY.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgagattttgcagtttattactgtcagcagcgtagcaactggcctcggttcactttttggccgaggggaccaaggccttgggagatcaaacgaactgtgggctgcaccatctgtcttctatt

SEQ ID NO: 785856 - DNA, 492 bp, Homo sapiens
  misc_feature: HIJSMM301DUKN2.41.72.G06.1.454.light.4.raw
tctatactatcacgaccggtgctcgatttagctacgactgcaagggaaaggggtccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctagactattatccccgtcagcatggacagcagcctcacaaattggatgtcggcggaggaccaagctgaccgtcctaggtcagcccaac

SEQ ID NO: 785857 - DNA, 510 bp, Homo sapiens
  misc_feature: HIJSMM301AOAKA.22.21.B10.1.454.light.4.raw
acatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcgttgggtgttcgggcggagggaccaagactgaccgtccaggtcagcccaaggcctcgccccctcggtcactctcg

SEQ ID NO: 785858 - DNA, 530 bp, Homo sapiens
  misc_feature: HIJSMM301AGSZT.9.1.A01.1.454.light.4.raw
tgatacgtctcacgaccggtgctcgatttagacgtctcatcaggggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacaggacttcaactctcaccatcagcagactggagcctgaggattttgcagtgtattactgtcagcagtatcataggtcaaacgaccttacggcccaaaggggacctaccggaacctgggagaagttaaaggaaacgtacggtggctacggcaccctaacgtcttggtctttccaatcctttcccc

SEQ ID NO: 785859 - DNA, 488 bp, Homo sapiens
  misc_feature: HIJSMM301E1KO9.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccccaagaacttttggccaggggaccaagctggagatacaaacgaactgtggctgcaccat

SEQ ID NO: 785860 - DNA, 506 bp, Homo sapiens
  misc_feature: HIJSMM301A3UR6.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccagacaaagcccccaaactcatgatttatgaggtcacaaagcggccctcaggggtccctgatcgcttctctgcctccaagtctggcaacacggcctccctcgaccgtctctgggctccagcctgaggatgaggctgattattactgcagctcatatgcaggcatcaacacctgttttcgggcggagggaccaagctgaccgtcctaggtcgacgcccaacggctcgtccccccg

SEQ ID NO: 785861 - DNA, 500 bp, Homo sapiens
  misc_feature: HIJSMM301CWAPE.12.37.D04.1.454.light.4.raw
  modified_base (464)..(464): a, c, t, g, unknown or other
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaattttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtactactttggccaggggaccaagctgganatcaaacgaactgtggctgcaccatcctgtcttcta

SEQ ID NO: 785862 - DNA, 490 bp, Homo sapiens
  misc_feature: HIJSMM301A0N0P.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcgagacacagattttacgactgaaaatcagtagagtggaggctgaggatgttgagtttatactgcatgcaagctctacaaactcctctcactttcggcggtagggaccaaggtggagatcaaacggaactgtc

SEQ ID NO: 785863 - DNA, 513 bp, Homo sapiens
  misc_feature: HIJSMM301AGHGY.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgtatcccacagggccaccggcatcccagccaggttcagtggcagcgggtctgggacagacttcactctcaccatcagcagcctagagtctgaagattttgctagtttattactgtcagcaggcgggcaattggccgctcacgtttcgggcgggggaccgaaggtggagtcaaacgaacgtgtggctggcaccatctgtcttcatccttcccgccctac

SEQ ID NO: 785864 - DNA, 383 bp, Homo sapiens; identical to SEQ ID NO: 447524
  misc_feature: HIJSMM301AQG3H.41.26.C04.1.454.light.4.raw

SEQ ID NO: 785865 - DNA, 500 bp, Homo sapiens
  misc_feature: HIJSMM301DHVCX.41.19.B08.1.454.light.4.raw
tctatactatcacgaccggtgctcgatttagtgagtcagtaaggggggggtctcaggaggcagcgctctcgggacgtctccaccatggcctgggctctgctatccctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagcttcatatacaagcagcagcactctcggtgtattcggcggagggaccaagctgaccgtctaggtcacgcccaaggctcgccccctcc

SEQ ID NO: 785866 - DNA, 521 bp, Homo sapiens
  misc_feature: HIJSMM301BD60D.12.21.B10.1.454.light.4.raw
atacgacgtacacgaccggtgctcgatttagtgtcgtcgcaagagaggagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttgaaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttataggctacgttgggtgtttcggcgggccggggaccaaaggtgaccgtcctaagtcagcccaaggctcgcccccgtcggtcactcc

SEQ ID NO: 785867 - DNA, 511 bp, Homo sapiens
  misc_feature: HIJSMM301DTUM8.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaataattattatacttcgtggacgtcggtccgaacggacgaacggtaggatagttacagtacgaacgtagtggcgttgaccg

SEQ ID NO: 785868 - DNA, 506 bp, Homo sapiens
  misc_feature: HIJSMM301AOV9Q.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggaggaccaagctgaccgtcctaggtcagccccaaggctgtccctcggt

SEQ ID NO: 785869 - DNA, 527 bp, Homo sapiens
  misc_feature: HIJSMM301E1T6J.7.34.D01.1.454.light.4.raw
cgtgtctctacacgaccggtgctcgatttagatcgtctgtgttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgatttattactgctgctcattatacgaggggacaggcatttattttgggtgttcgggcgggagggaccaaagctgaccgtctgtcgtcagcccaaggcctcgccccctcggtcacttccg

SEQ ID NO: 785870 - DNA, 520 bp, Homo sapiens
  misc_feature: HIJSMM301CH5D4.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggcctccaggctgacgatgaggctgatttattactgcagctcacatgcagttcagtaacaagtttcggggttttcggcgggagggaccaagctgaccgtcctaagtcagcccaaggctcgccccctcggtccactcttccg

SEQ ID NO: 785871 - DNA, 501 bp, Homo sapiens
  misc_feature: HIJSMM301DUT5E.48.59.F04.1.454.light.4.raw
agtatacatacacgaccggtgctcgatttagtacacacacttagggattggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcaactctcaccgtcagcagactggaccctgaagattttgcagtgtattactgtcagcagtatggtagctcaccgatcaccttcggccaagggacacgactggagtattaaccgaactgtggctagcaccatctgtcttcatt

SEQ ID NO: 785872 - DNA, 504 bp, Homo sapiens
  misc_feature: HIJSMM301AFCS7.9.81.H04.1.454.light.4.raw
tgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggacacggtcaccgtcctaggtcagcccaaggaccaacccccactcgtcact

SEQ ID NO: 785873 - DNA, 516 bp, Homo sapiens
  misc_feature: HIJSMM301B13OS.9.12.B01.1.454.light.4.raw
tgatacgtctcacgaccggtgctcgatttagtagtgtagattcggcgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactagcagctcatatgcaggccacccacaatgttcttacggaagtgggaccacggtcaccgtcctacggtcagcccaaggcccaacccccactcgtcacttccg

SEQ ID NO: 785874 - DNA, 517 bp, Homo sapiens
  misc_feature: HIJSMM301EHMAM.19.78.H01.1.454.light.4.raw
  modified_base (208)..(208): a, c, t, g, unknown or other
tactctcgtgcacgaccggtgctcgatttagtgtgagtagtttggggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccancttttcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggtctgattactactgctgctcatatgcaggtcgtatctcttattgtcttcggaactgggaccaaggtccaccgtcctaggtcagacccaaggcccaaccccacttcgcta

SEQ ID NO: 785875 - DNA, 524 bp, Homo sapiens
  misc_feature: HIJSMM301AK5N4.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacacccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcactcgtcctaggtcacgcccaaggcccaaccccactgtcactctgttcccaccctcct

SEQ ID NO: 785876 - DNA, 499 bp, Homo sapiens
  misc_feature: HIJSMM301EOKB9.19.71.G05.1.454.light.4.raw
tactctcgtgcacgaccggtgctcgattttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggccctgaccgattcagtggcagcgggtctgggacagatttcactctcaccatcagcagcctgcaggctgaagatgtggctagttattattgtcaacaatattattaatacttacgttggacgttcgtccgaagggaaccaaggtggatatactagacgactatggc

SEQ ID NO: 785877 - DNA, 489 bp, Homo sapiens
  misc_feature: HIJSMM301B2A3U.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctactagcctgaagattttgcaacttattattgtcaactaaagttatagagacccctgccactttccggccctggaccatagtggtatatgaacgaactagtggctgcac

SEQ ID NO: 785878 - DNA, 503 bp, Homo sapiens
  misc_feature: HIJSMM301B1V7V.21.81.H04.1.454.light.4.raw
tcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtctaggtcagcccaaggccaaccccactcgtca

SEQ ID NO: 785879 - DNA, 503 bp, Homo sapiens
  misc_feature: HIJSMM301CTBTD.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctggggctccaggctgaggacggaggctgattattactgcagctcatatacaagcaccagcactctctatgtcttcggactgggaccaaggtcaccgttccaggtcagcccaaggacccc

SEQ ID NO: 785880 - DNA, 489 bp, Homo sapiens
  misc_feature: HIJSMM301AUGLD.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacacgttcccctcgcacttttggccaggggaccaaagttgagatcaaacgaactgtggctgcaccatctgttt

SEQ ID NO: 785881 - DNA, 465 bp, Homo sapiens
  misc_feature: HIJSMM301C1VTN.43.71.G05.1.454.light.4.raw
  modified_base (461)..(461): a, c, t, g, unknown or other
tgtgagtagtcacgaccggtgctcgatttagtgtcgtcgcaagagagagggggagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaactacncaca

SEQ ID NO: 785882 - DNA, 492 bp, Homo sapiens
  misc_feature: HIJSMM301E22MU.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggtctaatcgggcctccggggtccctgacaggttcagtggcagtggatcaggcacagattttacactgaaaatcagcagagtggaggctgaggatgttggggtttattactgcatgcaagctctacaaactccttactacttttggaccgagggaccaagctaggagatcaaacgaacta

SEQ ID NO: 785883 - DNA, 500 bp, Homo sapiens
  misc_feature: HIJSMM301EJ2J6.49.20.B09.1.454.light.4.raw
  modified_base (433)..(433): a, c, t, g, unknown or other
agtcgagagacacgaccggtgctcgatttagtgtagtgtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtnttcgggcgggagggactacgctagaccgtccgtaggtcagcccaaggctcgccccctcggtcacgtt

SEQ ID NO: 785884 - DNA, 534 bp, Homo sapiens
  misc_feature: HIJSMM301EV019.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaataccaggcaaggcccccaaactcttgatttatgatgtctctaatcggccctccggcgtttctattcgcttctctggctccaagtctggcaacacggcctcctgaccatctctggactccagactgaggacgaggctgattattactgctgctcattatacaggggacaagctattatttgggtgttcgggtcggagggaaccaagctagaccgtcctagccggtacacggccccaagggtcctcggtacccccctcgggtccactt

SEQ ID NO: 785885 - DNA, 527 bp, Homo sapiens
  misc_feature: HIJSMM301AOXBH.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcactatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcggagggaccaggctgaccgtccgtaggtcagcccaaggctgccccctcggtcacctctcgttcccaccctt

SEQ ID NO: 785886 - DNA, 486 bp, Homo sapiens
  misc_feature: HIJSMM301AJITO.9.1.A01.1.454.light.4.raw
  modified_base (478)..(478): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgatgcagtctccgggcaccctgtctttctctccagggggagagagccaccctctcctgcaggaccagtcagagtgttaccagcaactacttggcctggtaccagcagaaatctggccagcctcccaggctcctcatctatggtgaatccaacagggccactggcatccccagacaggttcagtggcagtgggtctgggacagacttcactctcaccatcagcagactggagcctgaggattttgcagtgtattactgtcagcagtatcataggtcaaacaccttcggccaaggacacgactggagattaaagaacgtgtgctgcacatctntcttcatt

SEQ ID NO: 785887 - DNA, 519 bp, Homo sapiens
  misc_feature: HIJSMM301AQPDC.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttccggcccgtgggaccgaaacgtaggatatactaaacgaaacctaggtggcgtcgcgacccatctgtt

SEQ ID NO: 785888 - DNA, 513 bp, Homo sapiens
  misc_feature: HIJSMM301ALQLA.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagtctttgtcttcggaagtgggaccaaggtcaccgtcctaagtcacgcccaacggccaaccccactcgtcactctgttccccgccttccc

SEQ ID NO: 785889 - DNA, 524 bp, Homo sapiens
  misc_feature: HIJSMM301EFR5A.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaaggcccaaaccccgactgtcactctgttcccgccctcct

SEQ ID NO: 785890 - DNA, 454 bp, Homo sapiens; identical to SEQ ID NO: 534964
  misc_feature: HIJSMM301AQKII.19.86.H09.1.454.light.4.raw

SEQ ID NO: 785891 - DNA, 484 bp, Homo sapiens
  misc_feature: HIJSMM301AMS7N.4.71.G05.1.454.light.4.raw
agcactgtagcacgaccggtgctcgatttagtgtcgtcgcaagagagaggggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgttttattcagctccaacaataagaactacttagcttggtaccagcagaaaccaggacagcctcctaacctgctcatttactgggcatctacccgggaatccgggtccctgaccgattcagtggcagcgggtctgggacagatttcactctcaccatcaacagcctgcaggctgaagatgtggcagtttattactgtcagcagtattatataactcccttcactttcggcggagggaccaaggtggagatcaaacga

SEQ ID NO: 785892 - DNA, 490 bp, Homo sapiens
  misc_feature: HIJSMM301BJS7Y.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttattttgtcaacaggctaacactttccccctcactttcggcggagggaccaaggtggagatcaagcgaactgtgctgcaccatctgtctt

SEQ ID NO: 785893 - DNA, 521 bp, Homo sapiens
  misc_feature: HIJSMM301EXMF1.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccgttggggcaaagctgccctgacactgtctggtgtgcagcctggaggacgaggctgactattactgcctactctactttggtggtgctgtgcttattcggcgggacgggaccaagctgaccgtcgttaagtccacgcccaaggctcgccccctcggtcacctctcgttcccta

SEQ ID NO: 785894 - DNA, 351 bp, Homo sapiens
  misc_feature: HIJSMM301ELZUC.40.9.A09.1.454.light.4.raw
tctagcgactcacgaccggtgctcgatttagcgagacgcgcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactgggcgtcttcccgggagtccggggtcctgaccgatcagtgccagcgggtctgggacagacttcactctcacca

SEQ ID NO: 785895 - DNA, 524 bp, Homo sapiens
  misc_feature: HIJSMM301EQC9V.27.23.C01.1.454.light.4.raw
agcgtcgtctcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggtagggaccagggctgaccgtctaggtcagacccaaggctcgccccctggtcactctgttccccgcct

SEQ ID NO: 785896 - DNA, 499 bp, Homo sapiens
  misc_feature: HIJSMM301EDQ2U.10.17.B06.1.454.light.4.raw
  modified_base (413)..(413): a, c, t, g, unknown or other
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccagttcagtggcagtgggtcggggtcagagttcactctcaccatcagcagcctgcagtctgaagattttgctagtttattactgtctagcagtangatacctgcctccgtacacttttggccggggtaccaaggctggaaatcaagcgaactgtcggactgcaccatctgtcttcattccc

SEQ ID NO: 785897 - DNA, 484 bp, Homo sapiens
  misc_feature: HIJSMM301AFVNX.10.23.C01.1.454.light.4.raw
catagtagtgcacgaccggtgctcgatttagtacacgtgattagggattggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacaccaacaatgtcggcaacgaaggagcagcttggctgcagcagcaccagggccaccctcccaaactcctatcctacaggaataacaaccggccctcagggatctcagagagattctcttcattcaggtcaggaaacacagcctccctgaccattactggactccagcctgaggacgaggctgactattactgctcagcatgggacatcagcctcagtggttgggtgtcggcggaggaccaagctgaccgtctaggtcacg

SEQ ID NO: 785898 - DNA, 432 bp, Homo sapiens
  misc_feature: NA.22.41.D08.1.454.heavy.3.nb
acccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacaggcccctggacaacggcctgagtggatgggatggatgaacccttctaagggaaacacaaactatgcagagaggctccagggcagagtcaccatgaccgcagacacaccaacgaccacagcctacatggagttgaggagtctgagacctgacgacacggccgtatattactgcgcgagagggcgtttctacggtgactatgagtat

SEQ ID NO: 785899 - DNA, 472 bp, Homo sapiens
  misc_feature: NA.2.81.H04.1.454.heavy.3.nb
ctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaaactatgtggactccgtgaagggccgattcaccatctccagagacaacgacaagaatttagtgtatctgcaaatgagcagcctgagagccgaggacacggctgtgtattattgtgcgag

SEQ ID NO: 785900 - DNA, 469 bp, Homo sapiens
  misc_feature: NA.51.21.B10.1.454.heavy.3.nb
agggggagggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctccatgaccagaaatacgtccgcgaggacagtctacatggagttgagcagcctgagaactgacgacacggccatatattactgtgcgagagaccttgctggtccttttgacttctggggccagggaaccctggtcaccg

SEQ ID NO: 785901 - DNA, 464 bp, Homo sapiens
  misc_feature: NA.49.21.B10.1.454.heavy.3.nb
agggggctctgggagacgagcccagcactggaaggcgccggtgtttccattcggtgatcagcactgaacacagaggactcaccatggagtttgggctgagctgggttttcctcgttggtcttttaagaggtgtccagtgttatgtgcagttggtggagtctgggggaggcgtggtccagcctgggaagtcactgagactcgcctgtacaccctctggattcaccttcagcaactatgcaatgcactgggtccgcctggctcccggcaagggtctggactgggtggcaggtatatcagctgatgggaccaaaatatactacgcaaactccgtgaagggccgattcaccatatcaagagacacttccgatgacacaatctatctgcaaatgaacagcctgaaagttgacgacacgggtctttttactgtgcgcctggaagcagtggctggccacatgatgcttttg

SEQ ID NO: 785902 - DNA, 358 bp, Homo sapiens
  misc_feature: NA.16.29.C07.1.454.heavy.3.nb
agggaaaggggctggagtgggtctcagctattagtattagtggtgatagcacatactacgcagactccgtgaagggccggttcaccatctccagagacaattccaagaatatgttgtatctgcaaatgaacagcctgagagccgaggacacggccgtatattactgtgcgaaagatgtaaagtgggcgctactggactcgggggcttttgatatctggggccaagggacaatggtcaccgtctcttcagcctccaccaagggcccatcggtcttccccctggcaccctcctccaagagcacctctgggggcacagcggccctgggctgcctggtcaaggactacttccgagtagtaca

SEQ ID NO: 785903 - DNA, 448 bp, Homo sapiens
  misc_feature: NA.51.52.E08.1.454.heavy.3.nb
agagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgtgagagattttcggacaatccagagacccctgt

SEQ ID NO: 785904 - DNA, 460 bp, Homo sapiens
  misc_feature: NA.13.87.H10.1.454.heavy.3.nb
ttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgt

SEQ ID NO: 785905 - DNA, 471 bp, Homo sapiens
  misc_feature: NA.49.6.A06.1.454.heavy.3.nb
aggggagctctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactctgggggaggcttggtacagcctggggggtccctgagactctcctgtgcagcctctggattcacctttagcagttttgccatgggctgggtccgccaggctccagggaaggggctggagtgggtctcaactattagcggtattggtactaccacatactacgcagactccgtgaagggccgcttcaccatctccagagacaattccaagaacatggtgtttctgcaaatgagcagcctgagagccgaggacacggccgtatattactgtgcgaaagttcgcgtgctaggtacatttgactactggggaccg

SEQ ID NO: 785906 - DNA, 426 bp, Homo sapiens
  misc_feature: NA.51.7.A07.1.454.heavy.3.nb
aggggtccgggagaggagcccagcactagaagtcggcggtgtttccactcggtgatgagcactgaacacagaggactcaccatggagtttgggctgagctgggttttcctcgttgctcttttaagaggtgtccagtgtcaggtgcacctggtggaatctgggggaggcgtggtccagcctgggaggtccctgagactctcttgtgtaggctctggattcagcttcagcaactatggcatgcactgggtccgccaggccccaggcgaggggctgcagtgggtggcagttatatcgtctgatgcaagtaatgaacattatggagaatccgtgaagggccgattcaccatctccagagacaattccaggaacacggtgtttctgcaaatgaacaggctgatacctgaggacacggctgtctattattgt

SEQ ID NO: 785907 - DNA, 458 bp, Homo sapiens
  misc_feature: NA.4.12.B01.1.454.heavy.3.nb
tccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaaggcccatcggtc

SEQ ID NO: 785908 - DNA, 483 bp, Homo sapiens
  misc_feature: NA.5.33.C11.1.454.heavy.3.nb
ttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcagcctccaccaagggcccatcggtcttcccctggcgccctgctccaggagcacctccgagagcacagcggccctgggctgcctggtcaaggactacttcccgtgtctgat

SEQ ID NO: 785909 - DNA, 429 bp, Homo sapiens
  misc_feature: NA.7.10.A10.1.454.heavy.3.nb
aggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactactt

SEQ ID NO: 785910 - DNA, 444 bp, Homo sapiens
  misc_feature: NA.10.87.H10.1.454.heavy.3.nb
ttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttctttcatttgatgaaaaagggatattatgcgacctccgtgaagggccgattcagcatctccagagacatttccaaggccacggtgtatctgcaaatgaccagcctgagaagtgaggacacggctatgtactattgtgcgaaggaccttccac

SEQ ID NO: 785911 - DNA, 475 bp, Homo sapiens
  misc_feature: NA.14.66.F11.1.454.heavy.3.nb
agggtgccagggggaagaccgatgggcccaggactggtgaagccttcggagaccctgtccctcacctgcactgtctctggcggctccatcaatacttacaactggacctggatccggcagcccccagggaagggtctgaattggattgggtatatctctaacagtgggaggaccaactacaacccctccctccagagtcgagtcaccatttcattagacacgtccaagaaccagttctccctgaggttgaactctgtgaccgctgcggacacggccgtgtattattgtgcgagggtcggtggccacaatggcgagtacaactggttcgacccctggggccagggaaccctggtcaccgtctcctcagcctccaccaagggcccatcggtcttcccctggcaccctcctccaagagcacctctgggggcacagcggccctgggctgcctggtcaaggactacttccgtactagacg

SEQ ID NO: 785912 - DNA, 460 bp, Homo sapiens
  misc_feature: NA.26.23.C01.1.454.heavy.3.nb
tagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtcaccgtctcctcagcctccaccaagggcccatcggtcttcccctggcgccctgctccaggagcacctccgagagcacagcggccctgggctgcctggtcaaggactacttccagtatagtct

SEQ ID NO: 785913 - DNA, 368 bp, Homo sapiens
  misc_feature: NA.4.46.E02.1.454.heavy.3.nb
cttgagtggatgggaggctttgatcctgaagatgaagaaaccatctatgcacagaagttccagggcagagtcatcatgaccgaggacacatccacagacacagcctacatggagctccacagtctgagatttgaggacacggccgtttatttctgtacaaccgcctcggcaagccgaacttgtagtggtggtaggtgctactcccatggaacctggttcgactcctggggccagggaaccctggtcagcgtctcctcagcctccaccaagggcccatcggtcttccccctggcaccctcctccaagagcacctctgggggcacagcggccctgggctgcctggtcaaggactacttccctacagtgct

SEQ ID NO: 785914 - DNA, 612 bp, Homo sapiens
  misc_feature: NA.19.53.E09.1.454.heavy.3.nb
ttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 785915 - DNA, 609 bp, Homo sapiens
  misc_feature: NA.19.10.A10.1.454.heavy.3.nb
aggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 785916 - DNA, 634 bp, Homo sapiens
  misc_feature: NA.40.23.C01.1.454.heavy.3.nb
tagggattggggagctctgggagaggagccccagccctgagattcccaggtgtttccattcagtgatcagcactgaacacagaggactcaccatggagttgggactgagctggattttccttttggctattttaaaaggtgtccaatgtgaagtgcagctggtggagtctgggggaggcttggtgcagcctggcaggtccctgagactctcctgtgcagcctctggattcacttttggtgattatgccatgcactgggtccggcaagctccagggaagggcctggagtgggtctcaggtattagttggaatagtggaagtattgactatggggactctgtgaagggccgattcaccatctccagagacaacgccaagaactccctgtatctgcaaatgagcagtctgagagctgaggacacggccttgtattactgtgcaaaagatactaggggaatagtagtgtctcggcggcttggtgcttttgatatctggggccaagggacaatggtcaccgtctcttcagcctccaccaagggcccatcggtcttccccctggcgccctgctccaggagcacctccgagagcacagcggccctgggctgcctggtcaaggactacttccagtcgctaga

SEQ ID NO: 785917 - DNA, 516 bp, Homo sapiens
  misc_feature: NA.12.86.H09.1.454.heavy.3.nb
ttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagcggccctgggctgcctggtcaaggactacttcctacgtcgtat

SEQ ID NO: 785918 - DNA, 475 bp, Homo sapiens
  misc_feature: NA.40.44.D11.1.454.heavy.3.nb
agggggctttctgagagtcatggacctcctgcacaagaacatgaaacacctgtggttcttcctcctcctggtggcagctcccagatgggtcctgtcccaggtgcagctacagcagtggggcacaagactgttgaagccttcggagaccctgtccttcacctgcgctgtctatggtgggtccttcagtggttactactggacctggatccgccagcccccagggaaggggctggagtggattggggaaatcaatcatagtggaagcaccaactacaacccgtcactcaagagtcgactcaccatatcagtagacacgtccaagaaccagttctccctgaagctgagctctgtgaccgccgcggacacggctgtgtattactgtgcgagaggcttggtagcagtggctcccgggggcttttgactactggggccagggaaccctggtcaccgtctcctcagcctccaccaagggccc

SEQ ID NO: 785919 - DNA, 486 bp, Homo sapiens
  misc_feature: NA.53.64.F09.1.454.heavy.3.nb
aggggagcctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagagtctatgacatgagttgggtccgccaggctccggggaaggggctggagtgggtctcaacgatcagtgatagcggaagtaccacaaactacgccgcctccgtgaagggccgatgcaccgtctccagagacaattcgaaggacactttatatctgcaactcaacagactgacaaccgctgacacggccgtctattactgtgtcaaagaagacggaccgctggacgaggagccagaggaaaatcactactttgactact

SEQ ID NO: 785920 - DNA, 462 bp, Homo sapiens
  misc_feature: NA.47.23.C01.1.454.heavy.3.nb
tagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcagcattggcaatggtaacataaaacactcacagaagttccagggcagggtcaccattaccagagacatctccgcgaccacagcctacatggaactgagcagcctgacttctgaagacacggctatttactactgtgcgagagaggggtttgactggaactccttctacatggacgtctggggcaaaggga

SEQ ID NO: 785921 - DNA, 601 bp, Homo sapiens
  misc_feature: NA.5.70.G04.1.454.heavy.3.nb
agaggagccccagccctgagattcccaggtgtttccattcagtgatcagcactgaacacagaggactcaccatggagttgggactgaactggattttccttttggctatgttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaagatcgggacgaagtggtggtggctgcaatcgactactggggcctgggaaccctggtcaccgtctcctcagcctccaccaagggcccatcggtcttccccctggcaccctcctccaagagcacctctgggggcacagcggccctgggctgcctggtcaaggactacttcccgtgtctgat

SEQ ID NO: 785922 - DNA, 461 bp, Homo sapiens
  misc_feature: NA.26.57.F02.1.454.heavy.3.nb
ttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatgaacagcctgaaaaccgaggacacggccgtgtattactgtgccagacatccgtcgtattacg

SEQ ID NO: 785923 - DNA, 329 bp, Homo sapiens
  misc_feature: NA.14.77.G11.1.454.heavy.3.nb
aagggaaagggactggagtgggtggccaccatgcaaaaggatggaagtgacacatcctatgtgaactctgtgaagggccgattcaccatctccagagacaacgccaggaattcattgtatctgcaaatgaacaacctgagagccgaggacacgtctgtgtattactgtgtgagagatgttctccgttggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 785924 - DNA, 338 bp, Homo sapiens
  misc_feature: NA.3.59.F04.1.454.heavy.3.nb
tagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtgactgccccgaatactggggccagggaacccgggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 785925 - DNA, 477 bp, Homo sapiens
  misc_feature: NA.48.65.F10.1.454.heavy.3.nb
agggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattgtagtagtaccagctgctatttttgtccggtggttcgaccctggggccagggaaccctggtcaccgtctcctcagcct

SEQ ID NO: 785926 - DNA, 425 bp, Homo sapiens
  misc_feature: NA.13.74.G08.1.454.heavy.3.nb
aggggagctctgggagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgactcggctgtatactt

SEQ ID NO: 785927 - DNA, 435 bp, Homo sapiens
  misc_feature: NA.14.61.F06.1.454.heavy.3.nb
acccaaaaaccacacccctccttgggagaatcccctagatcacagctcctcaccatggactggacctggagcatccttttcttggtggcagcagcaacaggtgcccactcccaggttcagctggtgcagtctggagctgaggtgaagatgcctggggcctcagttgaggtctcctgcaggacttctggttacacctttaccaactatggtatcacctgggtgcggcaggtcccaggacaagggcttgagtggctgggatggatcagcggtttcgatgagaaaaccagttctgcacaaaagttccagggcagactcaccctgactacagacgcatcaacgggctcagccttcatgaccctgaggaacctgagacctgacgacgcggccatctattactgtgcgagagatgggtggcagctcgtctcaggaattgac

SEQ ID NO: 785928 - DNA, 462 bp, Homo sapiens
  misc_feature: NA.52.83.H06.1.454.heavy.3.nb
tcgcggggtctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccc

SEQ ID NO: 785929 - DNA, 471 bp, Homo sapiens
  misc_feature: NA.3.34.D01.1.454.heavy.3.nb
ttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 785930 - DNA, 428 bp, Homo sapiens
  misc_feature: NA.52.8.A08.1.454.heavy.3.nb
aggggctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcg

SEQ ID NO: 785931 - DNA, 430 bp, Homo sapiens
  misc_feature: NA.40.71.G05.1.454.heavy.3.nb
acccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccggacaagggcttgagtggatgggatggagcagcacttacaatggtgacacaaactatgcacagaagttccaggacagagtcaccatgaccacagacacatccaccagcacagcctatatggaggtgaggagcctgacatctgacgacacggccgtatattactgtgcgagagatcatcggaggtggaatgccgtgt

SEQ ID NO: 785932 - DNA, 477 bp, Homo sapiens
  misc_feature: NA.16.35.D02.1.454.heavy.3.nb
ttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccg

SEQ ID NO: 785933 - DNA, 451 bp, Homo sapiens
  misc_feature: NA.16.9.A09.1.454.heavy.3.nb
agggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtggccgcggccggta

SEQ ID NO: 785934 - DNA, 497 bp, Homo sapiens
  misc_feature: NA.49.5.A05.1.454.heavy.3.nb
agggcacgaccggtgctcgatttagatagatagacaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaatactacgcagactccgtgaagggccgattcaccatctcccgacacaattccaagaacacattgtttctactgctgaacagcctgagaagtgacgacacggctgtatatcactgtgcggcaggcaacgattactacccgaaggactacgtggg

SEQ ID NO: 785935 - DNA, 343 bp, Homo sapiens
  misc_feature: NA.47.29.C07.1.454.heavy.3.nb
agggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggcaccctcctccaagagcacctctgggggcacagcggccctgggctgcctggtcaaggactacttcctacgtgagct

SEQ ID NO: 785936 - DNA, 413 bp, Homo sapiens
  misc_feature: NA.8.71.G05.1.454.heavy.3.nb
cagagcctgctgaattctggctgaccagggcagtcaccagagctccagacaatgtctgtctccttcctcatcttcctgcccgtgctgggcctcccatggggtgtcctgtcacaggtacgactgcagcagtcaggtccaggactggtgaagccctcgcagaccctctcactcacctgtgtcatctccggggacagtgtctctaggcacggtagtacttggaattggatcaggcagtccccatcgagaggccttgagtggctgggaaggacattctacacgtccaaattgtataatgaatatgcagagtctgtgaagagtcgaataatcatcagcccagacacatcgaagaaccagttctccctggaactgacctctgtgactcccgaagacacggctgtttattactgtgcaag

SEQ ID NO: 785937 - DNA, 414 bp, Homo sapiens
  misc_feature: NA.12.78.H01.1.454.heavy.3.nb
aagaggaagactgacggtccccccaggagttcaggtgctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 785938 - DNA, 330 bp, Homo sapiens
  misc_feature: NA.3.42.D09.1.454.heavy.3.nb
agggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 785939 - DNA, 513 bp, Homo sapiens
  misc_feature: NA.40.9.A09.1.454.heavy.3.nb
agggggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagcctgacagccgaggacacggctgtttattactgtgcgagagatggcacgtcggggcggtgactttgactactggggccagggcaccctggtcaccgtctcctcagcctccaccaagggcc

SEQ ID NO: 785940 - DNA, 458 bp, Homo sapiens
  misc_feature: NA.52.9.A09.1.454.heavy.3.nb
agggggctctgggagaggagccccagccgtgagattcccaggagtttccacttggtgatcagcactgaacacagaccaccaaccatggagtttgggcttagttgggttttccttgttgctattttaaaaggtgtccagtgtgaggtgcagctggtggagtctgggggaggcttggtacagccagggcggtccctgagactctcctgtacagcttctggattcacctttggtgattatgctatgacatgggtccgccaggctccggggaaggggctggagtgggtaggtttctctagaagcaaatcctatggtgggacaacagaatacgccgcgtctgtggaaggcagattcaccatctcaagagatgattccaaaggcatcgcctatctgcaaatgaagagcctgaaaaccgaggacacagccgtgtacttctgtactagagtcttcttgtattatta

SEQ ID NO: 785941 - DNA, 568 bp, Homo sapiens
  misc_feature: NA.10.85.H08.1.454.heavy.3.nb
tcgcggggctcagagaggagccttagccctggactccaaggcctctccacttggtgatcagcactgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttcccctggcgccctgctccaggagcacctccgagagcacagcggccctgggctgcctggtcaaggactacttcccactactatg

SEQ ID NO: 785942 - DNA, 591 bp, Homo sapiens
  misc_feature: NA.40.86.H09.1.454.heavy.3.nb
ttgggtttgggggcagcgcctgctgaattctggctgaccagggcagtcaccagagctccagacaatgtctgtctccttcctcatcttcctgcccgtgctgggcctcccatggggtgtcttgtcacaggtacaactacagcagtcaggtccaggactggtgaagccctcgcagaccctctcactcacctgtgccatctccggggacagtgtctctagcaacaatgctgcttggaattggatcaggcagtccccatcgaggggccttgagtggctggggaggacatactacaggtccacgtggaaaaacgattatgcagcatctgtgaaaagtcgaataaccatcgacccagacacatccaagaaccagttctccctgcaactgaactctctgactcccgaagacacggctgtctattactgtgcatatggttcggggagttatccctattggggccagggaaccctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 785943 - DNA, 399 bp, Homo sapiens
  misc_feature: NA.5.34.D01.1.454.heavy.3.nb
ttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaac

SEQ ID NO: 785944 - DNA, 455 bp, Homo sapiens
  misc_feature: NA.47.81.H04.1.454.heavy.3.nb
agctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctggtacagcctggggggtccctgagactctcctgtgcagcctctggattcatcttcagtgactacgacatgcactgggtccgccaagttgcaggagaacctctggaatgggtctccgttattgctactggtggtgccacagactatgcaggctccgtgaggggccgattcaccatctccagagaaaatggcaagaactccttgtatcttcaaatgaacagcctgagagccggggacacggcggtgtattactgtgtaagagagctcgatggtaacaggggacttaat

SEQ ID NO: 785945 - DNA, 499 bp, Homo sapiens
  misc_feature: NA.49.81.H04.1.454.heavy.3.nb
cacgaccggtgctcgatttagtagtgtagattcgcggggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcacggaggacaagggtcgaccccgt

SEQ ID NO: 785946 - DNA, 230 bp, Homo sapiens
  misc_feature: NA.14.37.D04.1.454.heavy.3.nb
ttgggtttgggtgcgccagatgcccgggaaaggcctggagtggatgggaaggatcgaccccattgactcttatacgtactacagcccttctttccaaggccacgtcaccatctcaactgacaagtccacaagtactgcctacctgcagtggagcaacctgagggcctcggacaccgccatctattactgtgcgagacgtaattgtgttaatatgaactgttatttcaggg

SEQ ID NO: 785947 - DNA, 441 bp, Homo sapiens
  misc_feature: NA.11.63.F08.1.454.heavy.3.nb
aggggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcagggtcatcatgaccagggacacgtccatcagcacagcctacatggagctgagcaggctgacatctgacgacacggccgtgtattactgtgcgagagataaaggggattgtgatagtacc

SEQ ID NO: 785948 - DNA, 551 bp, Homo sapiens
  misc_feature: NA.3.20.B09.1.454.heavy.3.nb
agggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaagggcccatcggtcttcccctggcaccctcctccaagagcacctctgggggcacagcggcccg

SEQ ID NO: 785949 - DNA, 450 bp, Homo sapiens
  misc_feature: NA.11.38.D05.1.454.heavy.3.nb
ttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggcaccctcctccaagagcacctctgggggcacagcggccctgggctgcctggtcaaggactacttccgtatctctcg

SEQ ID NO: 785950 - DNA, 468 bp, Homo sapiens
  misc_feature: NA.52.75.G09.1.454.heavy.3.nb
agggggctctgagagaggagcccagccctgggattttcaggtgttttcatttggtgatcaggactgaacagagagaactcaccatggagtttgggctgagctggctttttcttgtggctattttaaaaggtgtccatggtgaggtgcggctgttggaatccggggggggcttgatacagcctggggggtccctgagactctcctgtgctgcctctggattcagtttcagtgacttagccatgagctgggtccgccaggctccagggaaggggctggaatgggtctcagtcgttactgctggacttactaccacatactacgcagactccgtgaagggccggttcgccatctccagagacaattccaagaataccctatatctgcaaatgagcagcctgagagccgaggacacggccgtatattactgtgcgatgggaagtagtggttactactactactttgacaact

SEQ ID NO: 785951 - DNA, 572 bp, Homo sapiens
  misc_feature: NA.48.42.D09.1.454.heavy.3.nb
agggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaagtgttttatccctggggccagggaaccctggtcaccgtctcctcagcctccaccaagggcccatcggtcttccccctggcaccctgctccaagagcacctctgggggcacagcggccctgggctgcctggtcaaggactacttcctatgtatact

SEQ ID NO: 785952 - DNA, 468 bp, Homo sapiens
  misc_feature: NA.9.14.B03.1.454.heavy.3.nb
ttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 785953 - DNA, 625 bp, Homo sapiens
  misc_feature: NA.48.44.D11.1.454.heavy.3.nb
aggggctgggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 785954 - DNA, 496 bp, Homo sapiens
  misc_feature: NA.52.61.F06.1.454.heavy.3.nb
cctctactgatgaaaaccagcccagccctgaccctgcagctctgggagacgagcccagcactggaaggcgccggtgtttccattcggtgatcagcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagcaactatgcaatgcactgggtccgcctggctcccggcaagggtctggactgggtggcaggtatatcagatgatgggaccaaaaatactacgcaaactccgtgaagggccgattcaccgtatctagagacagttccgatgacacaatctatctgcaaatgaacagcctgaaagttgacgacacgggtctttttactgtgcgcctgggagcagtggctggccacatgatgcttttg

SEQ ID NO: 785955 - DNA, 377 bp, Homo sapiens
  misc_feature: NA.11.62.F07.1.454.heavy.3.nb
aagggaaaggggctgcagtgggtctcaggcattggtaccagtgatgataagacacactacgcagactccgtgaagggccggttcaacatctccagagacaattccaagaacagcctatatctccaaatgaacagcctgagagccgaggacacggccgtctatttctgtgcgaaacacggctgtagtggaggtgactgctactccacggatttctactactacggcatggacctctggggccaagggaccacggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 785956 - DNA, 598 bp, Homo sapiens
  misc_feature: NA.4.30.C08.1.454.heavy.3.nb
aagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtctgggggaggcttggtccagcctggggggtccctgagactctcctgtgcagcctctggattcacctttactacctattggatggactgggtccgccaggctccagggaaggggctggagtgggtggccaacataaaccaagatggaagtgaacagtactatgtggactctgtgaagggccgattcaccatctccagagacaacgccaagaactcactgtatctgcaaatgaacagcctgagagccgaggacacggctatttattactgtgtgaaagagaactggttcttcgatctctggggccgtggcaccctggtcactgtctcctcagcctccaccaagggcccatcggtcttccccctggcgccctgctccaggagcacctccgagagcacagcggccctgggctgcctggtcaaggactacttccctacag

SEQ ID NO: 785957 - DNA, 474 bp, Homo sapiens
  misc_feature: NA.51.64.F09.1.454.heavy.3.nb
agggggctctgggagaggagcccagcactagaagtcggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctgggaggtccttgagactctcctgtgcagcctctggattcaccttcagagtctatggcatgaactgggtccgccaggctccaggcaaggggctggagtgggtggcattcatttcagaggatggaattaagagatactatacagactccgtgaagggccgattcaccatctccagagacaattccaagaactcgctctatctgcaaatgagcagcctgagacctgaggacacggctgtctattactgtgcgaaacggaatgagtgggaactagggtttgagaacggtatggacg

SEQ ID NO: 785958 - DNA, 439 bp, Homo sapiens
  misc_feature: NA.40.7.A07.1.454.heavy.3.nb
aggggacccaacaaccacatccctcctcagaagcccccagagcacaactccttaccatggactggacctggaggatcctctttttggtggcagcagccacaggtgtccactcccaggtccagcttgtgcagtctggggctgaggtgaagaagcctggggcctcagtgaaggtttcctgcacggcttctggatacaccttcactagatatgctatacattgggtgcgccaggcccccggacaaagacttgagtggatgggatggatccaccctggcaattataacacaaaacattcacagaagttccagggcagagtcaccattaccagggacacatccgcgagcacagtctacatggagctgagcagcctgagatctgaagacacggctgtgtattactgtgcgacgaatagtggctggcgagaggtgggatactactt

SEQ ID NO: 785959 - DNA, 571 bp, Homo sapiens
  misc_feature: NA.19.13.B02.1.454.heavy.3.nb
tccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgggacacggctgtgtattactgtgcgaggcggctggcaactacatccattacggtttggacgtctggggccaagggaccacggtcatcgtctccccagcctccaccaagggcccatcggtcttcccctggcgccctgctccaggagcacctccgagagcaca

SEQ ID NO: 785960 - DNA, 594 bp, Homo sapiens
  misc_feature: NA.17.31.C09.1.454.heavy.3.nb
agtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccacggtcaccgtctcctcaccctccaccaagggcccatcggtcttcccctggcaccctcctccaagagcacctctgggggcacagcggccctgggctgcctggtcaaggactacttccctagtctacg

SEQ ID NO: 785961 - DNA, 454 bp, Homo sapiens
  misc_feature: NA.52.71.G05.1.454.heavy.3.nb
agctctgagagaggagcccagccctgggattttcaggtgttttcatttggtgatcaggactgaacagagagaaatcaccatggagtttgggctgagctggctttttcttgtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctggagtgggtctcaggtattagtggtagtgctatgaccacattctacgcagactccgtgaagggccggttcaccatttccagagacaattccaagagtaccctgtatctgcaaatgaacagcctgagagccgacgacacggccgtatattactgtgcgaagcaattactctatggacattatggg

SEQ ID NO: 785962 - DNA, 448 bp, Homo sapiens
  misc_feature: NA.49.52.E08.1.454.heavy.3.nb
agagagaaagaaaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctataaatgcactgggtccgccaggctccaggcaaggggctggagtgggtggcacttatatcctatgatggaagcaataagcactacgcagagctccgtgaagggccgattcaccatctccagagacaattccaagaacacactgtctctcaaatgaacagcctgagagttgaggacacggctgtctattactgtgcgagagctaa

SEQ ID NO: 785963 - DNA, 453 bp, Homo sapiens
  misc_feature: NA.11.6.A06.1.454.heavy.3.nb
agggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaaggggctggagtgggttggccgtattaaaagcgaggctgctggtgggacaacagactacgctgcacccgtgaagggcagattcaccatctccagagatgattcaaggagcacagtgtttctacaaatgaacagcctgactgccggggacactgccgtgtattactgtgccagcagcagcacctggccact

SEQ ID NO: 785964 - DNA, 524 bp, Homo sapiens
  misc_feature: NA.51.67.G01.1.454.heavy.3.nb
ttgggtttggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatcacggaggacaacggtgacccccgtcgctcggtgcggaggtctggggccaagggaccacggtcatcgtctcctcagcctccacc

SEQ ID NO: 785965 - DNA, 425 bp, Homo sapiens
  misc_feature: NA.48.8.A08.1.454.heavy.3.nb
agggggagtctccctcactgcccagctgggatctcagggcttcattttctgtcctccaccatcatggggtcaaccgccatcctcgccctcctcctggctgttctccaaggagtctgcgcggaagtgcgcctggtgcagtctggagcagtggtgaagaggcccggggagtctctaaagatctcctgtcagggttctgaaggcgactttgacaccttctgggtcgcctgggtgcgccagaggcccggtaaaggactagagtatatgggcgtcatctatcctggtgactccgataccatatatactccgtcgtttcaaggccaggtcaccatgtctgccgacaagtccaagactgtcgcctacctccactgggccaaactgacgtcctccgacagcgccacttattactgtgcgagggtaggcactac

SEQ ID NO: 785966 - DNA, 435 bp, Homo sapiens
  misc_feature: NA.16.73.G07.1.454.heavy.3.nb
aggggtccgggagatcatgagggtgtccttgagtctgggggaggcgtggtccagcctggggggtcgctgagactctcctgtgcagcctctggattcaccttcagtacctatgccatacactgggtccgccagcctccaggcaaggggctggagtgggtggctcttatatcatctgatggaggtactgaatactacgcagactccgtgaagggccgattcaccatctccagagacaattcccagaacacactgtatctgcaaatgaacagcctgagaactgaggacacggctctatattactgtgcgagaggggggccggtgggagctcctccacggggccatgactcctggggccagggatccctggtcaccgtctcctcagcctccaccaagggcccatcggtcttcccctggcgccctgctccaggagcacct

SEQ ID NO: 785967 - DNA, 467 bp, Homo sapiens
  misc_feature: NA.14.85.H08.1.454.heavy.3.nb
tcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccagggaaggggctggagtggattggggaaatcagtcaaagtggaggcaccaagtacaacccgtccctcgagagtcgagtcaccatatcaatagacacgttccagaatcagttctccctgaggctgacttctgtgacagccgcggacacggctgtgtattactgtgcgagatctttcggctggtacgctcttgactactggggccagggaaccctggtcaccgtctcttcagcctccaccaaggg

SEQ ID NO: 785968 - DNA, 477 bp, Homo sapiens
  misc_feature: NA.18.39.D06.1.454.heavy.3.nb
cagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttccccctggcgccctgctccaggagcacctctgggggcacagcggccctgggctgcctggtcaaggactacttcccatactcgta

SEQ ID NO: 785969 - DNA, 593 bp, Homo sapiens
  misc_feature: NA.48.66.F11.1.454.heavy.3.nb
agggggagccccagccctgggattcccagctgtttctgcttgctgatcaggactgcacacagagaactcaccatggagtttgggctgagctgggttttccttgttgctattttaaaaggtatccagtgtgaggagcagctggtggagtccggcggaggcttagttcagccgggggggtccctgagactctcctgtgtggcctctggattcacaattaatccatattggatcctctgggtccgccaagttccagggaaggggctggtttgggtctcacgtatttatgctgctggagatacagcctacgcggactccgtgaagggccgattcaccatctctagagacaacgccaagaacacggtgactctgcaaatggacggtctgagggccgacgacacggctgtctactattgtgcaaaagggccgattaactcttacggtctggacgtctggggccaagggaccacggtcagcgtctcttcagcctccaccaagggcccatcggtcttccccctggcgccctgctccaggagcacctccgagagcacagcggccctgggctgcctggtcaaggactacttcctatgtatact

SEQ ID NO: 785970 - DNA, 357 bp, Homo sapiens
  misc_feature: NA.4.79.H02.1.454.heavy.3.nb
agggaaggggctggagtggctttcatacattgatagtagtgggaagatcatatactacgcagactctgtgaagggccgattcaccgtctccagagacaacgccaacaactcactgtttctgcaaatggacagcctgagagccgaggactcggctgtttattactgtgcgagagattccaggagtttgatgctagcgagggcctactatgactactggggccagggaaccaaggtcaccgtctcctcagcctccaccaagggcccatcggtcttccccctggcgccctgctccaggagcacctccgagagcacagcggccctgggctgcctggtcaaggactacttccctacagtgct

SEQ ID NO: 785971 - DNA, 358 bp, Homo sapiens
  misc_feature: NA.7.60.F05.1.454.heavy.3.nb
ggctccagggaaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgattttcttgtttgtctggggccagggaaccctggtcaccgtctcctcagcctccaccaagggcccatcggtcttccccctggcgccctgctccaggagcacctccgagagcacagcggccctgggctgcctggtcaaggactacttcctagagacacg

SEQ ID NO: 785972 - DNA, 464 bp, Homo sapiens
  misc_feature: NA.3.52.E08.1.454.heavy.3.nb
tcggcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttct

SEQ ID NO: 785973 - DNA, 462 bp, Homo sapiens
  misc_feature: NA.26.80.H03.1.454.heavy.3.nb
aagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcagggtcaccatgaccacggacacgtccataagcacagtttacatggaggtaaataggctgagatctgacgacacggccgtatattactgtgcgttattaacggacgattacgatgttttgattggtttttacg

SEQ ID NO: 785974 - DNA, 350 bp, Homo sapiens
  misc_feature: NA.13.77.G11.1.454.heavy.3.nb
aagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactggggccagggaaccctggtcaccgtctcctcaccctccaccaagggcccatcggtcttccccctggcaccctcctccaagagcacctctgggggcacagcggccctgggctgcctggtcaaggactacttccgtactagacg

SEQ ID NO: 785975 - DNA, 465 bp, Homo sapiens
  misc_feature: NA.3.85.H08.1.454.heavy.3.nb
tcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagtaattatgccatgagctgggtccgccaggctccagggaaggggctggagtgggtctcagctattagtgatcgtggtggtaacacatactacgcagactccgtgaagggccgcttcaccatctccagagacaattccaagaacacgctgcatctgcaaatgaacagcctgagagccgaggacacggccctttattactgtgcgaaaccaatcacgtataactggaactacgta

SEQ ID NO: 785976 - DNA, 459 bp, Homo sapiens
  misc_feature: NA.13.12.B01.1.454.heavy.3.nb
tcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttcccctggcgccctgctccaggagcacctccgagagcacagcggccctgggctgcctggtcaaggactacttccgtactagacg

SEQ ID NO: 785977 - DNA, 409 bp, Homo sapiens
  misc_feature: NA.9.53.E09.1.454.heavy.3.nb
ggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatca

SEQ ID NO: 785978 - DNA, 468 bp, Homo sapiens
  misc_feature: NA.4.67.G01.1.454.heavy.3.nb
ttgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccgggta

SEQ ID NO: 785979 - DNA, 465 bp, Homo sapiens
  misc_feature: NA.47.56.F01.1.454.heavy.3.nb
aacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatctccagagacaacgccaagaacacgctgtatctgcaaatgcacagtctgagagccgacgatgcggctgtatatttctgtgcaagagatcaactggtgggaccgactttatttcaggtctc

SEQ ID NO: 785980 - DNA, 434 bp, Homo sapiens
  misc_feature: NA.3.48.E04.1.454.heavy.3.nb
ctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgcccttgattacta

SEQ ID NO: 785981 - DNA, 470 bp, Homo sapiens
  misc_feature: NA.9.64.F09.1.454.heavy.3.nb
aggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccagggaagggcctggagtgggtggccaacataaaggaagatggaagtgagaagtcctatgtggactctgtgaagggccgattcatcatctccagagacaacgccgagaactccctgtatctgcaaatgaacagcctgagagtcgaggacacggctatgtattattgtgtgagagataaaagtggggccagggaaccctggtcaccgtctcct

SEQ ID NO: 785982 - DNA, 453 bp, Homo sapiens
  misc_feature: NA.10.29.C07.1.454.heavy.3.nb
agggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatgaacagcctgagagctgaggacacggctgtgtattactgtgcgaaagatatcgcggtgacta

SEQ ID NO: 785983 - DNA, 361 bp, Homo sapiens
  misc_feature: NA.52.66.F11.1.454.heavy.3.nb
aggggctggagtgggtctcaatgatcagtgatgatggacgtagcacaaaatacgccgactccgtgaagggccggtgcaccatctccagagacaattcgaaggacactctatacctgcaactcaacagactgacacccgcggacacggccgtctattactgtgtaaaagaagacggaccgctggacgaggagccagaggagaatcactactttgactactggggccagggaagactggtcaccgtctcctccgcctccaccaagggcccatcggtcttccccctggcaccctcctccaagagcacctctgggggcacagcggccctgggctgcctggtcaaggactacttcctatacgatcg

SEQ ID NO: 785984 - DNA, 478 bp, Homo sapiens
  misc_feature: NA.49.4.A04.1.454.heavy.3.nb
agggcacgaccggtgctcgatttagagtagtgatcaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatctcatatgatggaagcaagatatactacattgactccgtgaagggccgattcatcatctccagagacaactccgagaacacactgtatcttcaaatgaacaggttgagagctgaagacacggctttatattactgtgcgaacttaatcacgga

SEQ ID NO: 785985 - DNA, 512 bp, Homo sapiens
  misc_feature: NA.48.3.A03.1.454.heavy.3.nb
agggggctctgagagaggagcccagccctgggattttcaggtgttttcacttggtgatcaggactgaacagagagaactcaccatggagtttgggctgagctggctttttcttctggccattttaaaaggtgtccagtgtgaggagcagttgtcggaatctgggggagacctggtacagccgggggggtccctgacactctcctgtgtggcctctggattcatttttagcaaccacgccattacctgggtccgccagagtccagggaagggactggacggagtcgcgggtataagtggttttagtggaagtagattatacgcagagtccgtaaggggccggttcaccatctccagagacaattccaagaacacggcatatctacaaatgaacaacctgggcgccgaagacacggccgtctattactgtgcgagatcctctactagtgccgcgaggtactttgaactctggggtcagggaaccctggtcaccgtctcctcagcctccaccaac

SEQ ID NO: 785986 - DNA, 521 bp, Homo sapiens
  misc_feature: NA.8.39.D06.1.454.heavy.3.nb
cagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccaagggacaatggtcatcgtctcctcagcctccaccaagggcccatcggtc

SEQ ID NO: 785987 - DNA, 602 bp, Homo sapiens
  misc_feature: NA.19.86.H09.1.454.heavy.3.nb
ttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 785988 - DNA, 481 bp, Homo sapiens
  misc_feature: NA.51.62.F07.1.454.heavy.3.nb
aagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccggggcaaagtcacgttgaccgcggacacagtcacggacacagcctacatggaactcaacggcctcagatttgaggacacggccgtctattattgtgcgagagtgagaaattacggtggctactcccttgactactggggccagggaaccctggtcaccg

SEQ ID NO: 785989 - DNA, 358 bp, Homo sapiens
  misc_feature: NA.19.25.C03.1.454.heavy.3.nb
tgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagta

SEQ ID NO: 785990 - DNA, 407 bp, Homo sapiens
  misc_feature: NA.53.24.C02.1.454.heavy.3.nb
tagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggcc

SEQ ID NO: 785991 - DNA, 469 bp, Homo sapiens
  misc_feature: NA.9.12.B01.1.454.heavy.3.nb
tccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtgtacgcttttgatatctggggccaaggga

SEQ ID NO: 785992 - DNA, 429 bp, Homo sapiens
  misc_feature: NA.4.36.D03.1.454.heavy.3.nb
atctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaaggactacttccctacagtgct

SEQ ID NO: 785993 - DNA, 470 bp, Homo sapiens
  misc_feature: NA.52.81.H04.1.454.heavy.3.nb
ctcggggagaggagccccagccgtgagattcccaggagtttccacttggtgatcagcactgaacacagaccaccaaccatggagtttgggcttagctgggttttccttgttgctattttaaaaggtgcccaatgtgaggtgcagctggtggagtctgggggaggcttggtgcagccagggcggtccctgagactctcctgttcagcttccggagtcacctttggtcattatgctatgaactgggtccgccaggctccagggaagggcctgtcttgggtaggtttcattagaggcgacgcttttggtgggacaacagaatacgccgcgtctgtgaaaggcagattcaccatctcaagagatgattccaaaagcgtcgtctacttgcaaatgaacagcctgaaatccgaggacacagccgtgtattactgtactagagagtattggatcgggggaaaattactaactccggt

SEQ ID NO: 785994 - DNA, 432 bp, Homo sapiens
  misc_feature: NA.52.76.G10.1.454.heavy.3.nb
agggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgcagattctgcgaggggccgattcaccatatccagagacaactcccaagatatgatatatctacaaatgaacagcctgagacctgaggacacggctgtatattactgtgcgt

SEQ ID NO: 785995 - DNA, 495 bp, Homo sapiens
  misc_feature: NA.52.12.B01.1.454.heavy.3.nb
tccgcgggagtttccacttggtgatcagcactgaacacagaccaccaaccatggagtttgggcttagctgggttttccttgttgctattttaaaaggtgcccaatgtgaggtgcagctggtggagtctgggggaggcttggtgcagccagggcggtccctgagactctcctgttcagcttccggagtcacctttggtcattatgctatgaactgggtccgccaggctccagggaagggcctgtcttgggtaggtttcattagaggcgacgcttttggtgggacaacagaatacgccgcgtctgtgaaaggcagattcaccatctcaagagatgattccaaaagcgtcgtctacttgcaaatgaacagcctgaaatccgaggacacagccgtgtattactgtactagagagtattggatcgggggaaaattactactccggtatggacgtctggggccaagggaccacggtcaccgtctcctcagcctccaccaac

SEQ ID NO: 785996 - DNA, 632 bp, Homo sapiens
  misc_feature: NA.53.85.H08.1.454.heavy.3.nb
tcgcgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggacgcgtggtccagcctgggaggtccctgagactctcctgtgtagcctctggatttaccttcagggtctatgacatgcactgggtccgccaggctccaggcaaggggctggagtgggtggcacttatctcacatgatggaaataaaaaaactatggtgactccgtgaagggccgattctccgtctccagagacaattccaagaacaccttgtatctgcaaatgaacagcctgagatatgaggacacggctctgtattactgtgcgaaagaaaaggttactgtggaagagtgggagttattcgttggggaaggctttgatatctggggccaagggacagtggtcacagtctcttcagcctccaccaagggcccatcggtcttcccctggcaccctcctccaagagcacctctgggggcacagcggccctgggctgcctggtcaaggactacttcctcgtactgcg

SEQ ID NO: 785997 - DNA, 453 bp, Homo sapiens
  misc_feature: NA.51.1.A01.1.454.heavy.3.nb
aggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacacggctgtgtattattgtgcgaacttaatcacggaggacaac

SEQ ID NO: 785998 - DNA, 500 bp, Homo sapiens
  misc_feature: NA.40.59.F04.1.454.heavy.3.nb
tagggattggggagctctgggagtggagccccagccttgggattcccaagtatttggtattcagtgatcaggactgaacacacaggactcaccatggagttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcaaaaggggggagcagctcgtccatccacttcgactcctggggccagggaaccctggtcaccgt

SEQ ID NO: 785999 - DNA, 463 bp, Homo sapiens
  misc_feature: NA.10.30.C08.1.454.heavy.3.nb
aagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccggcaagctccagggaagggcctggagtgggtctctggaatcacttacaatagtgatttccttaaatatgcggactctgtgagggggcgtttcaccatctccagagacaacgccaggaactccctctatctacaaatgaacagtctgagacctgaggacacggccttatatttctgtgcaaaagatcttggagctggccgtgaccact

SEQ ID NO: 786000 - DNA, 423 bp, Homo sapiens
  misc_feature: NA.52.25.C03.1.454.heavy.3.nb
tctgggagaggagcccagcactagaagtcggcggtgtttccattcggtgatcagcactgaccacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcaatagctatggcatgcactgggtccgccaggctccaggcaaggggctgaggtgggtggccagtatgtcatatggtggacttaatgcatactatgcagactccgtgaagggccgattcatcatctccagagacaattccaagaacacgctgtatctgcaaatgaacagcctgagagctgaggacacggctgtgtattactgtgc

SEQ ID NO: 786001 - DNA, 441 bp, Homo sapiens
  misc_feature: NA.40.83.H06.1.454.heavy.3.nb
tcgcggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctgaggggccgattcatcatctctagagacaattcgaagaacacggcttatctgcaaatgaacagcctgacagtcgaggacacggctgtatatttctgtgcgaatgaggaa

SEQ ID NO: 786002 - DNA, 474 bp, Homo sapiens
  misc_feature: NA.48.86.H09.1.454.heavy.3.nb
ttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcct

SEQ ID NO: 786003 - DNA, 478 bp, Homo sapiens
  misc_feature: NA.47.53.E09.1.454.heavy.3.nb
ttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgacccctggggccagggaacccttgtcaccgtctcctcagcctccaccaagggcccacg

SEQ ID NO: 786004 - DNA, 443 bp, Homo sapiens
  misc_feature: NA.52.23.C01.1.454.heavy.3.nb
tagggattggggggggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaaataagaaatactatatagactccgtgaggggccgattcaccatctccagagacaattccaagaacacgctgtatctgcacatgaacagcctgagagccgaagacacgggtgtttattactgtgcgaacttaatt

SEQ ID NO: 786005 - DNA, 494 bp, Homo sapiens
  misc_feature: NA.48.41.D08.1.454.heavy.3.nb
agaggagccccagccctgagaatcccaggtgtttccattcagtgatcagcactgaacacagaggactcaccatggagttgggactgagctggattttccttttgactattttaaaaggtggtcactgtgaacggctactggtggagtctgggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagcgagaagattgactatgcggagtctgtgaaggggcgattcatcatctccagagacaacgccaagaactccctgtatttgcagatgaacaatctgagacctgacgacacggccttgtattattgtgcaaaagttgtggagtcacagtctctggactacggtatggacgtctggggccaagggaccacggtcacagtctcctca

SEQ ID NO: 786006 - DNA, 618 bp, Homo sapiens
  misc_feature: NA.9.78.H01.1.454.heavy.3.nb
agctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 786007 - DNA, 454 bp, Homo sapiens
  misc_feature: NA.13.85.H08.1.454.heavy.3.nb
tcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgtttattactgtgcgcgagataatagtcacaactggaacggcgttttggggt

SEQ ID NO: 786008 - DNA, 384 bp, Homo sapiens
  misc_feature: NA.14.23.C01.1.454.heavy.3.nb
tagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatctgacgacacggccgtgtattactgtgcga

SEQ ID NO: 786009 - DNA, 269 bp, Homo sapiens
  misc_feature: NA.18.53.E09.1.454.heavy.3.nb
ttgggttgggtgcccaagctgctggagggcacggtcaccacgctgctgagcagcctgagatctgaggacacggccgtgtattactgtgctagagagggacgtatagtgggagctccctttgacttctggggccagggaaccctggtcaccgtctcctcagcttccaccaagggcccatcggtcttccccctggcgccctgctccaggagcacctctgggggcacagcggccctgggctgcctggtcaaggactacttcccatactcgta

SEQ ID NO: 786010 - DNA, 476 bp, Homo sapiens
  misc_feature: NA.14.14.B03.1.454.heavy.3.nb
ttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttggggcttttgaccactggggccagggaaccctggtcaccgtctcttcagcctccaccaagggcccatcggtcttcccctggcaccctcctccaagagcacctctc

SEQ ID NO: 786011 - DNA, 536 bp, Homo sapiens
  misc_feature: NA.48.40.D07.1.454.heavy.3.nb
taacaacagagggggagccccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccgcttcaccgtctccagagacaacggcgagaatactctgtatttgcagatgagaaatctgagaggcgaggacaccgcgctttattattgtacaacgtcgttttacttttctaatggtggctcttacgaacgacatgactattggggtcggggaaccctggtcaccgtctcctcagcctccaccaagggcccatcggtctt

SEQ ID NO: 786012 - DNA, 341 bp, Homo sapiens
  misc_feature: NA.52.41.D08.1.454.heavy.3.nb
ctggagtgggtttcatacagtagtggttctagtactttcgcaaagtacgcagactctgtgaagggccgattcaccgtgtccagagacaacgccaagaactcaatgtatctgcagatgagcaacctgagagtcgacgacacggctgtttattactgttcgagactagcggatttttgggggtcggaatcacttgactactggggccagggagccctggtcaccgtctcctctgcctccaccaagggcccatcggtcttccccctggcaccctcctccaagagcacctctgggggcacagcggccctgggctgcctggtcaaggactacttcctatacgatcg

SEQ ID NO: 786013 - DNA, 623 bp, Homo sapiens
  misc_feature: NA.48.2.A02.1.454.heavy.3.nb
aggggtctcagagaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcactgtttctgcaaatgagcagcctgagagccgaggacacggctctatattactgtacgagagatttcagcccctcccaaagtggaaattattatgatgcatttgatatttggggccaggggacagtggtcacagtctcttcagcctccaccaagggcccatcggtcttccccctggcgccctgctccaggagcacctccgagagcacagcggccctgggctgcctggtcaaggactacttcctatgtatact

SEQ ID NO: 786014 - DNA, 493 bp, Homo sapiens
  misc_feature: NA.11.10.A10.1.454.heavy.3.nb
aggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaagggaccacggtcaccgtctcctcagcctccaccaagggcccatcggtcttccccctggcaccctcctccaagagcacctctgggggcacagcggccctgggctgcctggtcaaggactacttccgtatctctcgc

SEQ ID NO: 786015 - DNA, 442 bp, Homo sapiens
  misc_feature: NA.11.23.C01.1.454.heavy.3.nb
tagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 786016 - DNA, 467 bp, Homo sapiens
  misc_feature: NA.12.27.C05.1.454.heavy.3.nb
agggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcaactggtggagtctgggggaggcttggtacagccgggggggtccctgagactctcctgtgcaggctctggattcatctttaacaactatgccatgagctgggtccgccaggctccagggaaggggctggagtgggtctcagctattagtaatagtggtgatagcacatcctacgcagactccgtgaagggccgcttcaccatctccagagacaattccaagaacacgctgtatctccaaatgaacagtctcagagccgaggacacggccatatattactgtgcgaaagacacagccgcatttgggggagtcatcgt

SEQ ID NO: 786017 - DNA, 481 bp, Homo sapiens
  misc_feature: NA.7.71.G05.1.454.heavy.3.nb
agaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccaggcgggagttccaagtactcctttgacgtctggggccagggtacccg

SEQ ID NO: 786018 - DNA, 538 bp, Homo sapiens
  misc_feature: NA.4.25.C03.1.454.heavy.3.nb
ctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtcgtggggcctagggactacggtcaccgtctcctcagcctccaccaagggcccatcggtc

SEQ ID NO: 786019 - DNA, 592 bp, Homo sapiens
  misc_feature: NA.40.81.H04.1.454.heavy.3.nb
cacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggccctggg

SEQ ID NO: 786020 - DNA, 409 bp, Homo sapiens
  misc_feature: NA.40.68.G02.1.454.heavy.3.nb
agggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcag

SEQ ID NO: 786021 - DNA, 472 bp, Homo sapiens
  misc_feature: NA.52.39.D06.1.454.heavy.3.nb
cagttctttgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtggctccatcagcagtggtactttttactacagttggagtcgccagcccccagggaagggactagagtggattgggagtgttcatcataatgggaggaccttctacagcccgtccctcaagagccgagtcaccatatcaatggacacgtccaggaaccacctctccctgaacctcaactctgttacggccgcggacacggccgtgtattattgtgcgagggaggcccaaaatggtggcgactcgccttcacttgacctctggggccagggaaggctggtcatcgtctcct

SEQ ID NO: 786022 - DNA, 697 bp, Homo sapiens
  misc_feature: NA.51.11.A11.1.454.heavy.3.nb
agggctacgactgcagggtgtacacctgtggttctcggggctgccctttggctttggagatggttttctcgatgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtcttctctggattcaccttcagggtctatgacatgcactgggtccgccaggctccaggcaaggggctggagtgggtggcagttatatcatatgatggaagtaataaatactatgcagactccgtgaagggccgattcaccgtctccagagacaattccaagaatacgctgtatctgcacatgaacagcctgagagctgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 786023 - DNA, 588 bp, Homo sapiens
  misc_feature: NA.3.70.G04.1.454.heavy.3.nb
agaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccagcccggggggtccctgagactctcctgtgaagtctctgggttcactgtcagtagcaactacatgaactgggtccgccaggctccagggaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 786024 - DNA, 449 bp, Homo sapiens
  misc_feature: NA.52.77.G11.1.454.heavy.3.nb
aagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggctccaggcaaggggctggagtgggtggcagttatatcatatgatggaagtaagatatactatgcagactccgtgaagggccgattcaccatttccagagacaactccaagaacacgctgtatttgcaaatgaacagcctgagagctgaggacacggctgtgtattactgtgcgaacttaatcacgga

SEQ ID NO: 786025 - DNA, 505 bp, Homo sapiens
  misc_feature: NA.51.40.D07.1.454.heavy.3.nb
taacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaacacactgtttctgcacatgaaaagcctgagagctgaggacacggctgtttattactgtgcgaacttaatcacggaggacaacggtaaccccgtccgctcggtacggacgtcgtggggccaagggacca

SEQ ID NO: 786026 - DNA, 439 bp, Homo sapiens
  misc_feature: NA.14.59.F04.1.454.heavy.3.nb
tagggattgggggggagaggagcccagcactagaagtcggcggtgtttccattcggtgagcagcactgaacacagaggactcaccatggagtttgggctgagctgggttttcctcgctgctcttttaagaggtgtccagtgtcaggggcagctggtggagtctgggggaggcgtggtccagcctgggaggtccctgagactctcctgtgcagcgtctggattcaccttcagaaactctggcatgcactgggtccgccaggctccaggcaaggggctggagtgggtggcacttatatggtatgatggaagtaatgaaaactatgcagactccgtgaagggccgattcaccatctccagagacaattccaagaacacagtgtatctgcaaatgagcagcctgagagtcgaggacacggctgtgtattactgtgcgagagat

SEQ ID NO: 786027 - DNA, 642 bp, Homo sapiens
  misc_feature: NA.4.22.B11.1.454.heavy.3.nb
aggggagctctgggagaggagccccagccgtgagattcccaggagtttccacttggtgatcagcactgaacacagaccaccaaccatggagtttgggcttagctgggttttccttgttgctattttcaaaggtgtccaatgtgaggtgcaactgctggagtctggggggaggcttggtacagccagggcgctccctgacactctcctgtacaacttctgggttcatctttgctgattatactttgacctgggtccgccaggctccagggaaggggctggagtggattggtttcattagaagcaaaacttatggtgggacaccagaatatgccgcgtctgtgaaaggcagattcaccatctcaagagatgattccaaaagtgtcgcctacctccagatgactagcctgaagaccgaagactcagccctttattactgtgctagagatcgactggcccgttacgatttttggcgtggcccgacggaacatcctcagactcctggggtcagggaaccctggtcaccgtctcctcagcctccaccaagggcccatcggtcttccccctggcaccctcctccaagagcacctctgggggcacagcggccctgggctgcctggtcaaggactacttccctacagtgct

SEQ ID NO: 786028 - DNA, 490 bp, Homo sapiens
  misc_feature: NA.15.8.A08.1.454.heavy.3.nb
agggtcttcgtggctcacgtccaccaccacgcatgtgacctcaggggtccctgagactctcctgtgccgcctctggagcagagtctgaattcaccttcatgcactttgccatgagctgggtccgccaggctccggggaaggggctggagtgcgtcgcatgtataactaaaagtggagacatcacactctacgcagactccgtgaagggccgcttcaccatctccagagacaactccaagaacacgctgtccctggagatgaacagcctgagagccgaggacacggccatttattactgtgcgaaagatagttcggggagtaattatcgagaatactattttgactcctggggccagggagccctggtcaccgtctcctcagcctccaccaagggcccatcggtcttccccctggcaccctcctccaagagcacctctgggggcacagcggccctgggctgcctggtcaaggactacttccgctacgtaga

SEQ ID NO: 786029 - DNA, 472 bp, Homo sapiens
  misc_feature: NA.17.23.C01.1.454.heavy.3.nb
tagggattggggtctgagagaggagccttagccctagattccaaggcctatccacttggtgatcagcactgagcaccgaggattcaccatggaactggggctccgctgggttttccttgttgccctttttggaggtgtccaatgtgaggtgcagctggtggaatctgggggaggcctggtcaagcctggggggtccctgagactctcctgtacagcctctggattcaccttcaagaactacaacatgcactgggtccgccaggctccagggaagggactggagtgggtctcatccattagtagtggaagtagttacatatattccgcagagtcagtgaagggccggttcaccatctccagagacaacgccaagaactcactctttctgcaatgaacggcctgggacccgaagacacggctgtctattctgtgcgagagacgggggagtagtaactgctgtagaggtcaattt

SEQ ID NO: 786030 - DNA, 536 bp, Homo sapiens
  misc_feature: NA.5.41.D08.1.454.heavy.3.nb
catcacataacaaccagattcctcctctaaagaagcccctgggagcacagctcatcaccatggactggacctggaggttcctctttgtggtggcagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggcccctgggcagggacttgagtggctggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacctatatggtctggacgtctggggccaagggagcactgtcaccgtctcctcagcctccaccaagggcccatcggtcttcccctggcaccctcct

SEQ ID NO: 786031 - DNA, 538 bp, Homo sapiens
  misc_feature: NA.3.78.H01.1.454.heavy.3.nb
ctttctgagagtcatggacctcctgtgcaagaacatgaagcacctgtggtttttcctcctgctggtggcagctcccagatgggtcctgtcccaggtgcagctgcaggagtcgggcccaggactggtgaagccttcggagaccctgtccctcacctgcagtgtctctggctcctccatcagcagcggttactactggggctggatccggcagcccccagggaagggtctggagtggattgggagaatctatcatcttgggacgacctcctacaacccgtccctcaagagtcgagtcatcatatccctagacacgaccaagaaccagttctccctgaacctgagctctgtgaccgccgcagacacggccatgtattactgtgcgagggcatataactatggttattccgatgcttttgatgtctggggccaagggacagtggtcaccgtctcttcagcctccaccaagggcccatcggtcttcccctggcaccctcctccaagagcacctctgggggcacagcggccctgggctgcctgg

SEQ ID NO: 786032 - DNA, 466 bp, Homo sapiens
  misc_feature: NA.51.12.B01.1.454.heavy.3.nb
tccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagaggttcgcttactggttcgaggctctcccc

SEQ ID NO: 786033 - DNA, 630 bp, Homo sapiens
  misc_feature: NA.14.55.E11.1.454.heavy.3.nb
ttgggtttggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtctggggccaagggaccacggtcaccgtctcctcagcctccaccaagggcccatcggtcttcccctggcaccctcctccaagagcacctctgggggcacagcggccctgggctgcctggtcaaggactacttccg

SEQ ID NO: 786034 - DNA, 478 bp, Homo sapiens
  misc_feature: NA.14.76.G10.1.454.heavy.3.nb
agggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 786035 - DNA, 459 bp, Homo sapiens
  misc_feature: NA.16.28.C06.1.454.heavy.3.nb
aagaggaagactgacggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggaggttttactatgatattactggttacaaaaaagggtactactttgactactggggccagggaaccctggtcaccgtctcctcagcctccaccaagggcccatcggtcttcccctggcgccctgctccaggagcacctccgagaacacagcggccctgggctgcctggtcaaggactacttccgagtagtaca

SEQ ID NO: 786036 - DNA, 428 bp, Homo sapiens
  misc_feature: NA.48.79.H02.1.454.heavy.3.nb
agggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagcctacatggagctgagcagcctgagatctgaggacacggccgtgtattactgtgcgagagatcagag

SEQ ID NO: 786037 - DNA, 621 bp, Homo sapiens
  misc_feature: NA.9.33.C11.1.454.heavy.3.nb
ttgggtttgggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 786038 - DNA, 560 bp, Homo sapiens
  misc_feature: NA.48.75.G09.1.454.heavy.3.nb
agggggactcctgtgccccaccatggacacactttgctccacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaaacaggctcaccatcgccatggacacctccaaaaacaggtggtccttaaaatgaccaacatggacccaatggacagcgcgacatattactgtgcacacattgattgtggtcccaccaggtgtcccgggccctttgatatctggggccgggggacattcgtcaccgtctctgcagcctccaccaagggcccatcggtcttccccctggcgccctgctccaggagcacctccgagagcacagcggccctgggctgcctggtcaaggactacttcctatgtatact

SEQ ID NO: 786039 - DNA, 606 bp, Homo sapiens
  misc_feature: NA.51.78.H01.1.454.heavy.3.nb
agctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 786040 - DNA, 639 bp, Homo sapiens
  misc_feature: NA.16.67.G01.1.454.heavy.3.nb
ttgggtttggggagctctgagagaggagcccagccctgggatttccaggtgttttcatttggggatcaggactgaacagagagaactcaccatggagttagggctgagctggctttttcttgtggctattttaaaaggtgtccagtgtgaggtgcagctgttggagtctgggggaggcttggtacagcctggggggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggccggttctccatctccagagacacttccaagaacacggtgtatctgcaagtgcacagcctgagagccgaggacacggccatatattactgtgcgaaagatcgattccccctccgtagagatggctacaaaatctttctccgaattgacttctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 786041 - DNA, 441 bp, Homo sapiens
  misc_feature: NA.48.63.F08.1.454.heavy.3.nb
aggggtctgggagaggagccccagccgtgagattcccaggagtttccacttggtgctcagcactgaacacagaccaccaaccatggagttagggcttagctggcttttccttgttgctattttaaagggtatccgatgtgaagtgcagatggtggagtctgggggagggttggttcagccagggcggtccctgagactctcctgcacaacttctggattccccttttctgattatactatccactgggtccgccaggcgcccgggaaggggctggagtgggtaggtttcgttagcaagaaaccttatggtggtccaccggaatacgccgcgtctgtgaaaggcagattcatcatctcaagagaggattccaagaacaccgcctatctgcaaatgaacagcctgaaaatcgacgacacagccatttattactgtactagagc

SEQ ID NO: 786042 - DNA, 626 bp, Homo sapiens
  misc_feature: NA.40.22.B11.1.454.heavy.3.nb
agggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtatattactgtgcgagagagccaggtggctacaattggagatactactactactacggtatggacgtctggggccaagggaccacggtctccgtctcctcagcttccaccaagggcccatcggtcttccccctggcgccctgctccaggagcacctctgggggcacagcggccctgggctgcctggtcaaggactacttccagtcgctaga

SEQ ID NO: 786043 - DNA, 496 bp, Homo sapiens
  misc_feature: NA.8.37.D04.1.454.heavy.3.nb
ttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccaagggacaatggtcatcgtctcctcagcctccaccaagggcccatcggtcttcccctggcaccctcctccaagagcacctctgggggcacagcggccctgggctgcctggtcaaggactacttccgacacgcgag

SEQ ID NO: 786044 - DNA, 600 bp, Homo sapiens
  misc_feature: NA.15.87.H10.1.454.heavy.3.nb
ttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctggggccaagggaccacggtcaccgtctcctcagcctccaccaagggcccatcggtcttcccctggcaccctcctccaagagcacctctgggggcacagcggccctgggctgcctggt

SEQ ID NO: 786045 - DNA, 430 bp, Homo sapiens
  misc_feature: NA.4.1.A01.1.454.heavy.3.nb
aggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggttggatcaatggtgaaactggaaaaaccaaatattcaccgagcttccagggcagaatgaccatctcccgggacacatccgcgagcgcaatctatctggaactgagccgcctgacatctgcagactcggcagtatatttctgtgcgagagaggggaggatggttgaggggaa

SEQ ID NO: 786046 - DNA, 482 bp, Homo sapiens
  misc_feature: NA.13.35.D02.1.454.heavy.3.nb
ttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggccgcgacgagttcgactac

SEQ ID NO: 786047 - DNA, 511 bp, Homo sapiens
  misc_feature: NA.12.38.D05.1.454.heavy.3.nb
tgggttttccttgttgcttttttacaaggtgtccagtgtgaggtgcaactggtggagtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgcctggtcaaggactacttcctacgtcgtat

SEQ ID NO: 786048 - DNA, 416 bp, Homo sapiens
  misc_feature: NA.13.61.F06.1.454.heavy.3.nb
aggcttggtccagccgggggggtcactgagactctcctgtacagcctcgagattcattttcaggaattattggatgagttgggtccgccagtctccagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttccccctggcgccctgctccaggagcacctctgggg

SEQ ID NO: 786049 - DNA, 447 bp, Homo sapiens
  misc_feature: NA.4.53.E09.1.454.heavy.3.nb
ttgggtttggggggtccctgagactctcctgtacagtctctgcatctaccttcacttctttttggatgacctggctccgccgggctccagggagggggctggagtgggtggccaccatcaatcaagatggaagtgagagaacctatgtggactctgtgaagggccgattcaccatctccagagacaacgccaagaattctctgtatctgcaaatgaacagcctgagagccgaggactcggctgtctattactgtgcgaggaagaagtattactatgatacaagtgacatgggctggttcgacccctggggccagggaaccctggtcaccgtctcctcagcctccaccaagggcccatcggtcttcccctggcgccctgctccaggagcacctccgagagcacagcggccctgggctgcctggtcaaggactacttccctacagtgct

SEQ ID NO: 786050 - DNA, 431 bp, Homo sapiens
  misc_feature: NA.43.87.H10.1.454.heavy.3.nb
ttgggtttgggggaggcttggtccagcctggggggtccctgagactctcctgtgcagcctctggattcacctttggtagctattggatgaactgggtccgccaggctccagggaaggggccggagtgggtggccaacataagggaagatggaggtgacaaatcctatgtggactctgtgaagggccgattcaccatctccagagacaacgccaagaactcactatatctgcaaatgaccagcctgacacccgaggacacggctgtgtattactgtgcgagagaaagcgctattgtagtagggggtatggacgtctggggccaagggaccacggtcaccgtctcctcagcctccaccaagggcccatcggtcttcccctggcgccctgctccaggagcacctccgagagcacagcggccctgggctgcctgg

SEQ ID NO: 786051 - DNA, 433 bp, Homo sapiens
  misc_feature: NA.49.65.F10.1.454.heavy.3.nb
agggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactgggtccgccaggctccaggcacggggctggagtgggtggcagttatctcagatgatggaagtaaaaagtactattcggactccttgaagggccgattcaccatctccagagacaattccaagaacaccttgcatctacaaatgcacagtctgagacctgaggacacggctgtgtattactgtgcgaa

SEQ ID NO: 786052 - DNA, 452 bp, Homo sapiens
  misc_feature: NA.19.71.G05.1.454.heavy.3.nb
cagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgct

SEQ ID NO: 786053 - DNA, 478 bp, Homo sapiens
  misc_feature: NA.51.59.F04.1.454.heavy.3.nb
tagggattggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatgg

SEQ ID NO: 786054 - DNA, 506 bp, Homo sapiens
  misc_feature: NA.11.28.C06.1.454.heavy.3.nb
ctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgccaggctccagggcaggggctggaatggatttcatacattggtgaaagtggcagtcccatataccacgcagactctgtgaagggccggttcaccatctccagggacaactccaaaaactcactatatctggaaatgactagcctgagactcgaggacacggccgtttattactgtgcgacgcccgccgatagcagcatcatctactggggccaggggaccctggtcaccgtctcctctgcctccaccaagggcccatcggtcttccccctggcgccctgctccaggagcacctccgagagcacagcggccctgggctgcctggtcaaggactacttccgtatctctcg

SEQ ID NO: 786055 - DNA, 610 bp, Homo sapiens
  misc_feature: NA.52.20.B09.1.454.heavy.3.nb
aggggtctgggagacgagcccagcactggaagtcgccggtgtttccattcggtgatcatcactgaacacagaggactcaccatggagtttgggctgagctgggttttcctcgttgctcttttaagaggcgtccagtgttatgtgcagctggtggagtctgggggaggcgtggtccagcctgggaggtccctgagactcgcctgtaaaccgtccggatttaccttcagtaactatgcaatgcactgggtccgccaggctccaggcaaggggctggactgggtggcagctatatcatttgatggaagcaataaatactacgcagactccgtgaagggccgattcaccatttccagagacagctccgataacacggtctatctgcgaatgaacagcctgagacctgaggacacggctctttttactgtgcgccaggaagcagtggctggccacatgatgcttttgatatctggagccaagggacaatggtcatcgtctcttcggcctccaccaagggcccatcggtcttccccctggcaccctcctccaagagcacctctgggggcacagcggccctgggctgcctggtcaaggactacttcctatacgatcg

SEQ ID NO: 786056 - DNA, 464 bp, Homo sapiens
  misc_feature: NA.12.79.H02.1.454.heavy.3.nb
agggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgaggggcctgaggtctgacgacacggccctctattattgtgcgagaattaattttcgttattgttctggtgtgtgtgttcaatgtttgaccattc

SEQ ID NO: 786057 - DNA, 492 bp, Homo sapiens
  misc_feature: NA.17.34.D01.1.454.heavy.3.nb
ttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggccatggaaccccggtcaccgt

SEQ ID NO: 786058 - DNA, 620 bp, Homo sapiens
  misc_feature: NA.52.2.A02.1.454.heavy.3.nb
aggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaggtggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaaaatatactatgtagactccgtgaagggccgattcatcatctccagagacaattccgagaacaccctgtatctgcaaatgaacagcctgagagctgaggacacggctgtgtattactgtgcgaacttaatcacggaggacaacggtggcccccgtccgctcggtgcggaggtctggggccaagggaccacggtcaccgtctcctcagcctccaccaagggcccatcggtcttccccctggcaccctcctccaagagcacctctgggggcacagcggccctgggctgcctggtcaaggactacttcctatacgat

SEQ ID NO: 786059 - DNA, 521 bp, Homo sapiens
  misc_feature: NA.16.38.D05.1.454.heavy.3.nb
ttgggtttgggctgggagacgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgtgtgagactcttattgcgttcgggctttgactactggggccagggatccctggtcaccgtctcctcagcctccaccaagggcccatcggtc

SEQ ID NO: 786060 - DNA, 397 bp, Homo sapiens
  misc_feature: NA.21.77.G11.1.454.heavy.3.nb
aagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttctatcatatgatggacgttataaatcctatgcggactccgtgaagggccgattcaccatctccagagacaattccaagaacacgctgtatctgcagatgaacagc

SEQ ID NO: 786061 - DNA, 490 bp, Homo sapiens
  misc_feature: NA.4.59.F04.1.454.heavy.3.nb
tagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgatttttggagtggtaaccccttggctactggggccagggaaccctggtcaccgtctcttcagcctccaccaagggcccacg

SEQ ID NO: 786062 - DNA, 490 bp, Homo sapiens
  misc_feature: NA.48.19.B08.1.454.heavy.3.nb
agggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctgctatctgagctggttcgactgctggggccagggaaccctggtcaccgtctcctcagcctccaccaac

SEQ ID NO: 786063 - DNA, 499 bp, Homo sapiens
  misc_feature: NA.48.71.G05.1.454.heavy.3.nb
catcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgaagtctgaagacacgggcatatatttctgtgcgacagatggtcgtggattctcgtctgcttatggaggggaagactggttcgactccgtgggggccagggaaccctggtcatcgtctcgtcagcc

SEQ ID NO: 786064 - DNA, 448 bp, Homo sapiens
  misc_feature: NA.51.76.G10.1.454.heavy.3.nb
aggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaaggggctggagtgggtggcatttatatcagatgatggcagtaataaagagtatgcagtctccgtgaagggccgattcaccatctccagagacaattcccagaacacactgtatctgcaaatgaacagattgagagctgaggacacggctgtgtatttctgtgcgaaacgctatgagtgggta

SEQ ID NO: 786065 - DNA, 185 bp, Homo sapiens
  misc_feature: NA.22.11.A11.1.454.heavy.3.nb
aggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggg

SEQ ID NO: 786066 - DNA, 610 bp, Homo sapiens
  misc_feature: NA.40.70.G04.1.454.heavy.3.nb
aagggaaatgctttctgagagtcatggatctcatgtgcaagaaaatgaagcacctgtggtccttcctcctgctggtggcggctcccagatgggtcctgtcccagctgcagctgcaggagtcgggcccaggactggtgaagccttcggagaccctgtccctcacctgcactgtctctggtgcctccatcagcagtactagttactactggggctggatccgccagtccccagggaagggactggagtggattgcggctatttcttatagtgagaacacctactacaacccgtccctcaagagtcgagtcaccatatccgtagacacgtccaacaaccagttctccctgaacctgagccctgtgaccgtcgcagacacggctgtatattattgtgggagacgctttcgtgacttaggccctgactacggtggcccccataccgaggacgatttcctcggtatggacgtctggggccaagggaccacggttaccgtctcctcagcctccaccaagggcccatcggtcttccccctggcgccctgctccaggagcacctccgagagcacagcggccctgggctgcctggtcaaggactacttccagtcgctaga

SEQ ID NO: 786067 - DNA, 620 bp, Homo sapiens
  misc_feature: NA.10.35.D02.1.454.heavy.3.nb
ttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactacttcccactactatg

SEQ ID NO: 786068 - DNA, 602 bp, Homo sapiens
  misc_feature: NA.49.31.C09.1.454.heavy.3.nb
tctgagagaggagcccagccctgggattttcaggtgttttcatttggtgatcaggactgaacagagagaactcaccatggagtttgggctgagctggctttttcttgtggcttttttaaaaggtgtccagtgtgaggtggagctgttggagtctgggggaggcttggtacaatttggggggtccctgggactctcctgtgcagcctctggattcactttcagcagctatggcatgaactgggtccgccaggctccagaaaaggggctggagtgggtctcaggtattagtggtagtggtggtatcacatcctacgtagactccgtgaagggccggttcaccatctccagagacaattccaagaacaaactttatttgcacatggaaagcctgagagccgaggacacggccatatattactgtgcgagacgtgggaactacttaggaggtgcttttgatgtctggggccaagggacaatggtcaccgtctcttcagcctccaccaagggcccatcggtcttcccctggcaccctcctccaagagcacctctgggggcacagcggccctgggctgcctggtcaaggactacttcctctctcgact

SEQ ID NO: 786069 - DNA, 502 bp, Homo sapiens
  misc_feature: NA.53.61.F06.1.454.heavy.3.nb
ctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaaacggtttgagtgggaattaggggctgagtacggtatggacgtctggggccaagggaccacggtcaccgtctcctc

SEQ ID NO: 786070 - DNA, 459 bp, Homo sapiens
  misc_feature: NA.21.27.C05.1.454.heavy.3.nb
agggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagacacgtccaagaatcaggtctccctccacctaatgtctgtcactcccgacgacacggcagtttatttttgtgcaagagggatcacattcggtgactacctccttgactcctgg

SEQ ID NO: 786071 - DNA, 594 bp, Homo sapiens
  misc_feature: NA.10.38.D05.1.454.heavy.3.nb
ttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttcccactactatg

SEQ ID NO: 786072 - DNA, 425 bp, Homo sapiens
  misc_feature: NA.21.61.F06.1.454.heavy.3.nb
acccaaaaaccacacccctccttggaagaatcccctagatcacagctcctcaccatggactggacctggagcatccttttcttggtggcagcagcaacaggtgcccactcccaggttcagatgatgcagtctggagctgaggtgaagaagcctggggcctcagtgaaggtctcctgcaaggcttctggtttcacctttaccagctataatatcggctgggtgcgacaggcccctggacaaggacttgagtggatgggatggatcagcgcttacaatggttacacaaactatgcacagaaactccagggcagagtcaccatgaccacagacacatccacgagcacagcctacatggagctgaggagcctgagatctgacgacacggccgtgtattactgtgcgagaggcttagcagtggcccggtt

SEQ ID NO: 786073 - DNA, 615 bp, Homo sapiens
  misc_feature: NA.49.80.H03.1.454.heavy.3.nb
aagggaaaggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggact

SEQ ID NO: 786074 - DNA, 609 bp, Homo sapiens
  misc_feature: NA.16.71.G05.1.454.heavy.3.nb
agctctgagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 786075 - DNA, 503 bp, Homo sapiens
  misc_feature: NA.21.46.E02.1.454.heavy.3.nb
tgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttcccgagcgacga

SEQ ID NO: 786076 - DNA, 453 bp, Homo sapiens
  misc_feature: NA.52.42.D09.1.454.heavy.3.nb
agggaaaggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagc

SEQ ID NO: 786077 - DNA, 333 bp, Homo sapiens
  misc_feature: NA.7.37.D04.1.454.heavy.3.nb
ttgggtttgggtggccgaaatcaccggagatggaggtgtgcaatactatgcggactctgtgaggggccgattcactgtctccagagacaacaccaagaactcactgtatctgcaaatgaacagcctgagagtcgaggacagtggtgtatattactgtgcgagccccggcgcttttgggcggaattcgggactgtggggccagggaaccctggtcagcgtctcagcctccaccaagggcccatcggtcttccccctggcgccctgctccaggagcacctccgagagcacagcggccctgggctgcctggtcaaggactacttcctagagacacg

SEQ ID NO: 786078 - DNA, 496 bp, Homo sapiens
  misc_feature: NA.40.67.G01.1.454.heavy.3.nb
ttgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagttttccctgacgctgacgtctgtgaccgccgcagacacggctgtctattattgtgcgagactagccttctgtagtgggggtacttgcaacccgggatactactccaccttcggcttggacatctgggccggaggggcctcggtcgtcgtttcctc

SEQ ID NO: 786079 - DNA, 466 bp, Homo sapiens
  misc_feature: NA.10.5.A05.1.454.heavy.3.nb
aggggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggttgcgccagatgcccggggaaggcctggagtggatggggatcatcaatcttggtagctctgaaaccagatacaccccgtccttccaaggccgggtcaccatctcagccgacaggtccatcagtactacctacttggagtggattagcctgaaggcctcggacaccgccatgtattactgtacgagacttgaacggggattctattatggcgcgatctggggccagggaaccctggtcacc

SEQ ID NO: 786080 - DNA, 436 bp, Homo sapiens
  misc_feature: NA.8.42.D09.1.454.heavy.3.nb
agggaaagggggggagaggagcccagcactgggattccgaggtgtgtccattcggtgatcagcactgaacacagaggactcaccatggagttctggctgggctgggttttccttgttgcaatttcaaaaggtgtccagtgtgaggtgcagctggtggagaatggagggggcttgatccagccgggggggtccctgagactctcctgtgcagcctctggcttcaccatcagtagagactacatgagctgggcccgccaggctccagggaaggggctggagtgggtctcagttatttatcgcgatggtggcacacactacgcagactccgtgaagggcagattcaccgtctccagagacaattccaagaacatggtgtatcttcaaatgaacagactaacagccgaggacacggccgtatattactgtgcgagacatg

SEQ ID NO: 786081 - DNA, 599 bp, Homo sapiens
  misc_feature: NA.40.27.C05.1.454.heavy.3.nb
agggtttggggatgctttctgagagtcatggatctcatgtgcaagaaaatgaagcacctgtggttcttcctcctgctggtggcggctcccagatgggtcctgtcccagttgcagttgcaggagtcgggcccaggactggtgaagacttcggagaccctgtccctcacgtgcactgtctctggtggctccatccgcaatcgtcgattctattggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 786082 - DNA, 501 bp, Homo sapiens
  misc_feature: NA.13.57.F02.1.454.heavy.3.nb
ttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttgggtccgccagcccccagggaaggggctggagtggattggggaaatctttcatagcgggatcaccaactacaacccgtccctcaagagtcgagtcaccatatctatagacaagtccaagaaccacttctccctgaacgtgagttctgtgaccgccgcggacacggccgtgtattactgtgcgagaggattgtggttttactctggttcaatgagttattatgtctttgactattggggccagggaaccctggtcaccgtctcctcagcctccaccaaggg

SEQ ID NO: 786083 - DNA, 438 bp, Homo sapiens
  misc_feature: NA.51.53.E09.1.454.heavy.3.nb
ttgggtttggggtctggggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggcgtggtccagcctgggaggtccctgagactctcctgtgcaggctctgcatttcccttcagtaactacgctatcgattgggtccgccaggctccaggcaagggactggagtgggtggcagttatttcagctgatggaggcaataagttttacggagattctgcgaggggccgattcaccatatccagagacaactcccaagatatgatatatctgcaaatgaacagcctgagacctgaggacacggctatgtattattgtgcgt

SEQ ID NO: 786084 - DNA, 476 bp, Homo sapiens
  misc_feature: NA.49.83.H06.1.454.heavy.3.nb
tcgcgggcgggatgggggcagggtgtacacctgtggttcgtcctcctgctggtggcggctcccagatgggtcctgtcccagctgcaactgcaggagtcgggcccaggactggtgaagccttcggagaccctgtccctcacctgcagtgtctctggtggctccatcagcagtagtgattactactggggctggatccgccagcccccagggaagggactggagtggattgggagtgtcttttatactggaaacacctactacaacccgtccctcaagagtcgagtcagcatatcagtagacacgtccaagagccagttctctctgaagctgacgtctctgaacgccgcggacacggccatttattactgtgcgagtaccccggaacctttttacgatttttggagtggttactataccggtatggggccttttgacttctggggccagggaaccctggtcaccgtctcctcagcctc

SEQ ID NO: 786085 - DNA, 355 bp, Homo sapiens
  misc_feature: NA.10.42.D09.1.454.heavy.3.nb
agggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaaggactacttcccactactatg

SEQ ID NO: 786086 - DNA, 481 bp, Homo sapiens
  misc_feature: NA.4.35.D02.1.454.heavy.3.nb
ttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatggttcgggagatcccagtggttttgatatatggggccaggggacagcggtcaccgtctcttcag

SEQ ID NO: 786087 - DNA, 461 bp, Homo sapiens
  misc_feature: NA.10.23.C01.1.454.heavy.3.nb
tagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaac

SEQ ID NO: 786088 - DNA, 451 bp, Homo sapiens
  misc_feature: NA.47.78.H01.1.454.heavy.3.nb
ctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaataaatatgtcatatctacaaatggatagcctgaaaatcgaggatacaggtgtttattactgttccacagggaatgcggttctct

SEQ ID NO: 786089 - DNA, 610 bp, Homo sapiens
  misc_feature: NA.47.85.H08.1.454.heavy.3.nb
tcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactacttcctacgtgagct

SEQ ID NO: 786090 - DNA, 341 bp, Homo sapiens
  misc_feature: NA.9.80.H03.1.454.heavy.3.nb
aagggaaaggggctggtgtgggtcgcacgtattaatgaagacgggactactataaattacgcggactccgtgaagggccgattcaccatctccagagacgacgccaagaacacgctgtatctgcaaatgaacagtctgagagtcgaggacacggctgtatattactgcgcaaaggattgtttcggggagactgactcctggggccagggaaccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 786091 - DNA, 438 bp, Homo sapiens
  misc_feature: NA.11.26.C04.1.454.heavy.3.nb
aggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 786092 - DNA, 614 bp, Homo sapiens
  misc_feature: NA.49.26.C04.1.454.heavy.3.nb
acggtgttttcgagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccagggaaccctagtcaccgtctcctcagcctccaccaagggcccatcggtcttccccctggcaccctcctccaagagcacctctgggggcacagcggccctgggctgcctggtcaaggactacttcctctctcgact

SEQ ID NO: 786093 - DNA, 619 bp, Homo sapiens
  misc_feature: NA.48.60.F05.1.454.heavy.3.nb
gggaaaggggtctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 786094 - DNA, 452 bp, Homo sapiens
  misc_feature: NA.51.81.H04.1.454.heavy.3.nb
agctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccct

SEQ ID NO: 786095 - DNA, 612 bp, Homo sapiens
  misc_feature: NA.48.1.A01.1.454.heavy.3.nb
agggaaagggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcagggggaggcctggtcaagcctggggggtccctgagactctcctgtgcaacctctggattcacattcactagatataccatgaactgggtccgccaggctccagcgaaggggctggagtgggtctcctccataagtagtggcagttcttacttacattacgcagactcagtgaagggccgattcgccatctccagagacaacgccaacaactcactgtttctgcagatggacaacctgagaggcgaggacacggctgtatattactgtgtctccccatacatcgcagctcgtggcacggactactggggccagggaaccctagtcaccgtctcctcagcctccaccaagggcccatcggtcttcccctggcgccctgctccaggagcacctccgagagcacagcggccctgggctgcctggtcaaggactacttcctatgtatact

SEQ ID NO: 786096 - DNA, 587 bp, Homo sapiens
  misc_feature: NA.17.10.A10.1.454.heavy.3.nb
ccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttctggggccaggggaccacggtgatcgtctcatcagcctccaccaagggcccatcggtcttccccctggcaccctcctccaagagcacctctgggggcacagcggccctgggctgcctggtcaaggactacttccctagtctacg

SEQ ID NO: 786097 - DNA, 469 bp, Homo sapiens
  misc_feature: NA.12.25.C03.1.454.heavy.3.nb
acccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcct

SEQ ID NO: 786098 - DNA, 455 bp, Homo sapiens
  misc_feature: NA.3.26.C04.1.454.heavy.3.nb
aagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactacttccgagtgcgtct

SEQ ID NO: 786099 - DNA, 382 bp, Homo sapiens
  misc_feature: NA.11.22.B11.1.454.heavy.3.nb
aagggaaggggctagagtggattggggaaatcaatgatagtggaagcaccaactacaacccgtccctcaagagccgagtcaccatatcagtagacacgtccaagaaccagttctccctgaagttgacctccgtgaccgccgcggacacggctgtgtattattgtgcgagaggggttaatggcgccttaatgatgacccgggcgcggccggtgtacaatggagggagttacatggacgtctggggcaaagggaccacagtcatcgtctccgcagcttccaccaagggcccatcggtcttccccctggcgccctgctccaggagcacctctgggggcacagcggccctgggctgcctggtcaaggactacttccgtatctctcg

SEQ ID NO: 786100 - DNA, 483 bp, Homo sapiens
  misc_feature: NA.47.6.A06.1.454.heavy.3.nb
agcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgattttggagtggccttgataactggggccaggggatcctggtcaccgtctcctcagcctccaccaac

SEQ ID NO: 786101 - DNA, 503 bp, Homo sapiens
  misc_feature: NA.9.86.H09.1.454.heavy.3.nb
ttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcct

SEQ ID NO: 786102 - DNA, 610 bp, Homo sapiens
  misc_feature: NA.9.31.C09.1.454.heavy.3.nb
agaggagccccagccttgggattcccaagtgttttcattcagtgatcaggactgaacacagaggactcaccatggagtttgggctgagctggattttccttgctgctattttaaaaggtgtccagtgtgaggtgcaactggtggagtctgggggaggctcggtcaagcctggggagtcccttagactctcctgtgcaacctctggattcaatttcgacatcgcctggatgagttgggcccgccaggctccagggaaggggctggagtgggttggacgtcttaaaagcaagggtagcggtgggacagcagactacgcttcatccgtgaagggcagattcagcatttccagagacgatgcaagacagatgatgtatttacagatgaacagcctaaaaatcggagacacagccctatatttctgcgtcttcatttcgcagtgggagctccggtttacggtcggtgacttctggggccggggagccatggtcaccgtctcctcagcctccaccaagggcccatcggtcttccccctggcgccctgctccaggagcacctccgagagcacagcggccctgggctgcctggtcaaggactacttccagacgtatca

SEQ ID NO: 786103 - DNA, 540 bp, Homo sapiens
  misc_feature: NA.3.55.E11.1.454.heavy.3.nb
ttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcggtcttcccctggccaccctcctccaagagcacctctgggggcacagcggccctgggctgcctggtcaaggactacttccgagtgcgtct

SEQ ID NO: 786104 - DNA, 561 bp, Homo sapiens
  misc_feature: NA.13.11.A11.1.454.heavy.3.nb
acacagcctactctgaggcatcccttccagaagtcactatacagtaggagacatgcaaatggggtcctccctctgccgatgaaaaccagcccagccctgaccctgcagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgct

SEQ ID NO: 786105 - DNA, 484 bp, Homo sapiens
  misc_feature: NA.51.36.D03.1.454.heavy.3.nb
atctctcttggggatgctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggaaggggctggattggattggcagtatcagttatactgggaccaccttcttcaagtcgtcgctcaagagtcgagtcaccatgaccgcggacacgtccaaggaccagttctccctgaagctgacctctgtgaccgccgcagacacggctttgtatttctgtgctagatataatgtgggtgacagtggtgcctactacggagcttttgatatttggggccaaggcacgaaggtcaccgtctcatcacg

SEQ ID NO: 786106 - DNA, 495 bp, Homo sapiens
  misc_feature: NA.26.78.H01.1.454.heavy.3.nb
agacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgttttactgtgcgagagagatgacgatgtacagtgggaactaccctgatgctttcgatatctggggccaagggacaatggtcaccgtctc

SEQ ID NO: 786107 - DNA, 470 bp, Homo sapiens
  misc_feature: NA.48.4.A04.1.454.heavy.3.nb
agggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccagggaaacctggtcaccgtctccccagcttccaccaagggccc

SEQ ID NO: 786108 - DNA, 601 bp, Homo sapiens
  misc_feature: NA.52.19.B08.1.454.heavy.3.nb
agggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgatcaggctgagagctgaagacacggctttatattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggt

SEQ ID NO: 786109 - DNA, 484 bp, Homo sapiens
  misc_feature: NA.10.9.A09.1.454.heavy.3.nb
agggggctctgggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccaagtactcctttgacgtctggggccg

SEQ ID NO: 786110 - DNA, 378 bp, Homo sapiens
  misc_feature: NA.13.78.H01.1.454.heavy.3.nb
ctcgtccactgacatggtgacgcgactattgagggacgggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttcctagtacgtga

SEQ ID NO: 786111 - DNA, 575 bp, Homo sapiens
  misc_feature: NA.16.68.G02.1.454.heavy.3.nb
tctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtccctcacctgcactgtctctggtggctccttcagcagttactactggagctggatccgtcagctcccagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 786112 - DNA, 511 bp, Homo sapiens
  misc_feature: NA.22.28.C06.1.454.heavy.3.nb
aagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcagtccccagggcagggactggaatggattggatatttccatacgactgcgatgaccaactgcaacccctccctcagggctcgagtcagcctgtcagtagacacgtccaagaaccagacttccctgagactgacctctgtgaccgccgcagacacggccgtgtatttctgtgtcggtacgagtgtccatgacagtcacaaacaactggtctcctggggccagggaaccctggtcaccgtctcctcagcctccaccaagggcccatcggtcttccccctggcaccctcctccaagagcacctctgggggcacagcggccctgggctgcctggtcaaggactacttccagacgtatca

SEQ ID NO: 786113 - DNA, 608 bp, Homo sapiens
  misc_feature: NA.15.34.D01.1.454.heavy.3.nb
ttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatctgggggaggcttggtccagcctggggggtccctgagactctcctgtgcagcctctggattcagttctagtaaatactggataagttgggtccgccaggctccagggaaggggctggagtggatggccaatatgaaccaagacggaagtgataaacatcatgtgggctctgtgcagggccgattcactatctccagagacaacgccaagaatctagtgtatttgcaaatgaacagcctgagagccgacgacacggctgtgtattactgtgcgggagggccggagtggtatttggatactttctggggccaggggaccctggtcaccgtctcctcagcctccaccaagggcccatcggtcttccccctggcgccctgctccaggagcacctccgagagcacagcggccctgggctgcctggtcaaggactacttccgctacgtaga

SEQ ID NO: 786114 - DNA, 443 bp, Homo sapiens
  misc_feature: NA.53.80.H03.1.454.heavy.3.nb
aagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgt

SEQ ID NO: 786115 - DNA, 430 bp, Homo sapiens
  misc_feature: NA.51.85.H08.1.454.heavy.3.nb
tcgcgggggctctgggagaggagaccagcactagaagtcggcggtgtttccattcggtgatcagcactgaacacagaggtctcaccatggagtttgggctgcgctggattttcctcgttgctctttttagaggtgcccagtgtcagatacaactggtggagtcggggggaggcgtggtccagcctggggggtccctgagagtctcgtgtgcagcctctggattcaccttcaggcgttacggcatgaactgggtccgccaggctccaggcaaggggctggagtgggtggctgtcataacatttgatggaactaagaaatattatgcagactccgtgaagggccgattcaccatctccagagacaattcaaaggacaccctatatttagaaatgagcagcctgagacctgcggacacggctgtgtattactg

SEQ ID NO: 786116 - DNA, 585 bp, Homo sapiens
  misc_feature: NA.15.16.B05.1.454.heavy.3.nb
ttgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttccccctggcgccctgctccaggagcacctccgagagcacagcggccctgggctgcctggtcaaggactacttccg

SEQ ID NO: 786117 - DNA, 450 bp, Homo sapiens
  misc_feature: NA.26.37.D04.1.454.heavy.3.nb
ttgggtttggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggagcaggtagtggagtctgggggaggcgtggtccagcctggggggtccctgagactctcctgtgcagcctctggattcaccttcagtacctacgccatgcactggatccgccaggctccaggcaaggggctagagtgggtggctcttatatcatatgatggaagtaatgaacattacgcagactccgtgaagggccgattcaccgtctccagagacaattccaagagcacgatgtttctgcaaatgaacagcctgagagttgaggacacgggtgtctatttctgtgcgcgagtccgggt

SEQ ID NO: 786118 - DNA, 569 bp, Homo sapiens
  misc_feature: NA.53.62.F07.1.454.heavy.3.nb
aagggaaaggggtagtcgcataaagggaaagggggaggtgtgtcacaagatttgggctctgggagacgagcccagcactggaagtcgccggtgtttccattcggtgatcatcactgaacacagaggactcaccatggagtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctatgcactgggtccgccaggctccaggcaaggggctggagtgggtggcacttatctcatctgatggaagagatgtctattacgcagactccgtgaagggccgattcaccatctccagagacaattccaagaacacactgtatctgcaaatggacagtctgagaactgaagacacggctgtgtattactgtgcgagtgagatgtcttactatgatgccagtggtttagtaccgttcgacccctggggccagggaaccctggtcaccgtctcctcagcttcca

SEQ ID NO: 786119 - DNA, 631 bp, Homo sapiens
  misc_feature: NA.49.43.D10.1.454.heavy.3.nb
aggggctgagagaggagcccagccctgggattttcaggtgttttcatttggtgatcaggactgaacagagagaactcaccatggagtttgggctgagctggctttttcttgtggctattttaaaaggtgtccactgtgaggtgcaactgttggaatctgggggagacttggtaaagccgggggggtccctgagactctcctgtgcagtctcgggattcacctttagagtctatgccatgcactgggttcgccaggccccagggaaggggctggagtgggtctctgccattagtggaagtggtgatctcagatactacggagactccgtgaagggccggttcaccatctccagagacaactccaagaatacgctctatctacacatgaaaaacctaagagccgacgacacggccgtctattactgtgcaaagtgggtcatggactacgatgatactagtggctattactccggtgactactttgactactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 786120 - DNA, 630 bp, Homo sapiens
  misc_feature: NA.10.79.H02.1.454.heavy.3.nb
agggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttccccctggcgccctgctccaggagcacctccgagagcacagcggccctgggctgcctggtcaaggactacttcccactactatg

SEQ ID NO: 786121 - DNA, 448 bp, Homo sapiens
  misc_feature: NA.52.30.C08.1.454.heavy.3.nb
aagggaaagggggagcccagcactggaaggcgccggtgtttccattcggtgatcagcactgaacacagaggactcaccatggagtttgggctgagctgggttttcctcgttgctcttttaagaggtgtccagtgttatgtgcagctggtggagtctgggggaggcgtggtccagcctggcaggtcactgagactcgcctgtacaccctctggattcaccttcagcaactatgctatgcactgggtccgcctggctcccggcaagggtctggactgggtggcaggtatatcagctgatgggaccaaaaatactacgcaaactccgtgaagggccgattcaccatatcaagagacagttccgatgacacagtctatctgcaaatgaacagcctgaaagttgacgacacgggtcttttttactgtgcgcctggaagcagtggctggccaca

SEQ ID NO: 786122 - DNA, 459 bp, Homo sapiens
  misc_feature: NA.10.55.E11.1.454.heavy.3.nb
ttgggtttgggctcaactctcttgtccaccttggtgttactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccaagggacaatggtcatcgtctcctcacg

SEQ ID NO: 786123 - DNA, 400 bp, Homo sapiens
  misc_feature: NA.21.67.G01.1.454.heavy.3.nb
ttgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcgcaacggaaagatggagtatggtcaggaatttcagggcagaattaccttgaccacagactcatccacgggcacagcctacttggaactgaggaacctgagaatggacgacacggcca

SEQ ID NO: 786124 - DNA, 564 bp, Homo sapiens
  misc_feature: NA.51.80.H03.1.454.heavy.3.nb
aagggaaagggggcagagcctgctgaattctggctgaccagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaagggcccatcggtcttcccctggcgccctgctccaggagcacctccgagagcacagcggccctc

SEQ ID NO: 786125 - DNA, 486 bp, Homo sapiens
  misc_feature: NA.12.75.G09.1.454.heavy.3.nb
agggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttatttctttgactcctggggccagggaaccctggtcaccgtctcct

SEQ ID NO: 786126 - DNA, 428 bp, Homo sapiens
  misc_feature: NA.52.67.G01.1.454.heavy.3.nb
ttgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgagaggggaaatgggtaa

SEQ ID NO: 786127 - DNA, 444 bp, Homo sapiens
  misc_feature: NA.51.29.C07.1.454.heavy.3.nb
agggaaaggggacagtgagtctccctcactgcccagctgggatctcagggcttcattttctgtcctccaccatcatggggtcaaccgccatcctcgccctcctcctggctgttctccaaggagtctgtgccgaggagcagctggtgcagactggaacagaggtgaaaagccgggggagtctctgaagatctcctgtaagggttctggacacagctttatcaactactggatcggctgggtgcgccagatgcccgggaaaggcctggagtggatgggcatcatctatcctggtgactctgatgtcagatacagcccgtccttccgcggccaggtcaccttctcagccgacaagtccatcgacaccgtctacctgcagtggagcagcctgaaggcctcggacaccgccatgtattactgtgcgagacagacaagagacggctacaa

SEQ ID NO: 786128 - DNA, 472 bp, Homo sapiens
  misc_feature: NA.53.2.A02.1.454.heavy.3.nb
aggggatactttctgagagtcctggacctcctgtgcaagaacatgaaacatctgtggttcctccttctcctggtggcagctcccagatgggtcctgtcccaggtgcagctgcaggagtcgggcccaggactcgtgaagccttcggagaccctgtccctcacctgcattgtctctggtggctccatcagtacttactactggacctggatccggcggtccccagggaggggactggagtggattgggaatgtccgttacagtgggaccaccaactacaacccctccctcaagagtcgagtcaccatatcagtagacacgtccaagaaccgcttctccctgaatctgaactctgtgaccgctgcggacacggccctctattactgtgcgagagtctacgcgccggacgacgatattttgactggttatcacaacccactatattactttgactactggggccagggaaccctgg

SEQ ID NO: 786129 - DNA, 612 bp, Homo sapiens
  misc_feature: NA.4.19.B08.1.454.heavy.3.nb
aggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaagaacacactgtatctggaaatgaccagcctgagaggtgacgacacgggtgtttattactgtgcgcgggatagaggctcatcgtggatacaactatggtttgattactggggccacggaaccctggtcaccgtctcttcagcttccaccaagggcccatcggtcttccccctggcgccctgctccaggagcacctctgggggcacagcggccctgggctgcctggtcaaggactacttccctacagtgct

SEQ ID NO: 786130 - DNA, 611 bp, Homo sapiens
  misc_feature: NA.10.28.C06.1.454.heavy.3.nb
agctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgaggacacggctctctattactgtgcgagagccccgaaaatagggtctacgattactcattctgactactggggccagggaaccctggtcaccgtctcctcagcctccaccaagggcccatcggtcttcccctggcgccctgctccaggagcacctccgagagcacagcggccctgggctgcctggtcaaggactacttcccactactatg

SEQ ID NO: 786131 - DNA, 597 bp, Homo sapiens
  misc_feature: NA.51.46.E02.1.454.heavy.3.nb
agaggagcccagcactagaagtcggcggtgtttccattcggtgatcagcactgaacacagaggactcaccatggagtttgggctgagctgggttttcctcgttgctcttttaagaggtgtccagtgtcaggtgcaggtggtggagtcggggggaggcgtggtccagcctgggaggtccctgagactctcctgtgcagcctctaaattcagtttcagtagatttggcgtgcactgggtccgccaggctccaggcaaggggctggagtgggtggcagttatatcatatgatggaaagaataaatactatggagactccgtgaagggccgattcaccatctctagagacaatctcaaggagacagtgcatctgcaaatgaacagcctgagaggtgacgacacggctgtgtattactgtcacctcgagagcagcaattggagagaggtttttgatatctggggccaagggactatggtcaccgtctcttcagcctccaccaagggcccatcggtcttccccctggcaccctcctccaagagcacctctgggggcacagcggccctgggctgcctggtcaaggactacttcctcgtagcact

SEQ ID NO: 786132 - DNA, 266 bp, Homo sapiens
  misc_feature: NA.47.84.H07.1.454.heavy.3.nb
ccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctggggcacagcggccctgggctgcctggtcaaggactacttcctacgtgagct

SEQ ID NO: 786133 - DNA, 426 bp, Homo sapiens
  misc_feature: NA.48.7.A07.1.454.heavy.3.nb
aggggcagggtgtacacctgtggttctcggggctgtcctttggttttggagatggttttctcgatgggggctgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggattttgtcggcgtggtgattgttacagtcagaatcgtcgattgtggttcgacccctggggccagggaaccctgctctccgtctcctcagcttccaccaagggcccatcggtcttccccctggcgccctgctccaggagcacctctgggggcacagcggccctgggctgcctggtcaaggactacttcctatgtatact

SEQ ID NO: 786134 - DNA, 349 bp, Homo sapiens
  misc_feature: NA.16.24.C02.1.454.heavy.3.nb
tagggaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaaggactacttccgagtagtaca

SEQ ID NO: 786135 - DNA, 519 bp, Homo sapiens
  misc_feature: NA.52.14.B03.1.454.heavy.3.nb
tccgcggggctttctgagagtcatggacctcctgtgcaagaacatgaagcacctgtggttcgtcctcctgctggtggcggctcccagatgggtcctgtcccagctgcaactgcaggagtcgggcccaggactggtgaagccttcggagaccctgtccctcacctgcactgtctctggtggctccatcagcagtagtgattactactggggctggatccgccagcccccagggaaggggctggagtggattgggagtgtcttttatagtggaaacacctactacaacccgtccctcaagagtcgagtcaccatatcagtagacacgtccaagagccagttctccctgaagctgacgtctctgaacgccgcggacacggccgtttattactgtgcgagtaccccggaacctttttacgatttttggagtggatactataccggtatggggccttttgacttctggggccagggaaccctggtcaccgtctcctcagcctccaccaagggcccatcggtctt

SEQ ID NO: 786136 - DNA, 445 bp, Homo sapiens
  misc_feature: NA.53.73.G07.1.454.heavy.3.nb
aggggctgaaagcatcatccaacaaccacatcccttctctacagaagcctctgagaggaaagttcttcaccatggactggacctggagggtcttctgcttgctggcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtggatctacaagttactcacagagaatgcagggccgaattaccatgaccagagacacgtccacgagtacagtctacatggaggtgagcagcctgagatctgaggacacggccatgtattactgtgcgatcttagtggattacgactacaattt

SEQ ID NO: 786137 - DNA, 448 bp, Homo sapiens
  misc_feature: NA.13.1.A01.1.454.heavy.3.nb
aggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactactatta

SEQ ID NO: 786138 - DNA, 438 bp, Homo sapiens
  misc_feature: NA.4.37.D04.1.454.heavy.3.nb
ttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatatttctgtgcgaggg

SEQ ID NO: 786139 - DNA, 613 bp, Homo sapiens
  misc_feature: NA.14.25.C03.1.454.heavy.3.nb
agacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttcccctggcaccctcctccaagagcacctctgggggcacagcggccctgggctgcctggtcaaggactacttccgtactagacg

SEQ ID NO: 786140 - DNA, 606 bp, Homo sapiens
  misc_feature: NA.22.36.D03.1.454.heavy.3.nb
atctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttccacgcgtatgt

SEQ ID NO: 786141 - DNA, 438 bp, Homo sapiens
  misc_feature: NA.40.42.D09.1.454.heavy.3.nb
agggaaaggggaagcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaaccctggggcctcagtgaaggtttcctgcaaggcatctggatacaccttcaccaggtattttatgcactgggtgcgacaggccccgggacaagggcttgagtggatgggcataatcaacccaagtggtggtagcacaacctacacacagaagttccagggcagagtcaccgtgaccagcgacacgtccacgactacagtctacatgcaactgagcagcctgaggtctgaggacacggccgtgtattactgtgcgagagatgatactagtgg

SEQ ID NO: 786142 - DNA, 617 bp, Homo sapiens
  misc_feature: NA.19.85.H08.1.454.heavy.3.nb
tcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtctgggggaggcttggttcagcctggagggtccctgagagtctcctgcacagcctctggattcaccttcagtaactatgagatggactggatccgccaggctccaggaaaggggctggagtggattgcctatgtcactagtgagggcgaagtcacgtcctacgcggactctgtgcggggccggtttaccatctccagagacaatgccaagaagacgctctttctgcaattggacggcctgagagtcgaagacacggctatttattactgtgtgagagaggggggcactggctggtcgggtcgatcttttgatttgtggggccaaggatcaagcgtctccgtctcttcagcctccaccaagggcccatcggtcttccccctggcaccctcctccaagagcacctctgggggcacagcggccctgggctgcctggtcaaggactacttcccacgagagta

SEQ ID NO: 786143 - DNA, 472 bp, Homo sapiens
  misc_feature: NA.10.59.F04.1.454.heavy.3.nb
tagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccagggagccctggtcaccgtctcctcacg

SEQ ID NO: 786144 - DNA, 627 bp, Homo sapiens
  misc_feature: NA.51.9.A09.1.454.heavy.3.nb
agggggctctcagagaggtgccttagccctggattccaaggcatttccacttggtgatcagcactgaacatagaggactcaccatggagttgggactgtgctgggttttccttgttgctattttagaaggtgtccagtgtgaggtgcggctggtggagtctgggggaggcttggtacagcctggggggtccctgacactctcctgtgcagcctctggattccccttcagaacttatgaaatgaactgggtccgacaggctccagggaaggggctggagtgggtttcacacattagtagtggtggaagtaccatattctacgcagactttgtgcagggccgattcaccatctccagagacgacgccaagaattcactgtatctgaaaatgaacagcctgagagccgacgacacggctgtttattactgtgcgagagattactatcatagtagtggttttttccctactactccggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 786145 - DNA, 624 bp, Homo sapiens
  misc_feature: NA.51.31.C09.1.454.heavy.3.nb
agctctgagagaggagcccagccctgggattttcaggtgttttcatgtggtgatcaggactgaacagagagaactcaccatggagtctgggctgacgtggctttttcttgtggctattttaaaaggtgtccagtgtgacgtgcagctggtggagtctgggggaggcttgatacagccgggggggtccctgagactctcatgtagaacctctggcttcatgtttagagtctatgacatgagttgggtccgccaggctccggggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagaagacggaccgctggacgaggagccagaggagaatcactactttgactactggggccagggaagactggtcaccgtctcctccgcctccaccaagggcccatcggtcttccccctggcaccctcctccaagagcacctctgggggcacagcggccctgggctgcctggtcaaggactacttcctcgtagcact

SEQ ID NO: 786146 - DNA, 592 bp, Homo sapiens
  misc_feature: NA.9.70.G04.1.454.heavy.3.nb
cctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggaccaaggtcaccgtctcctcagcctccaccaagggcccatcggtcttcccctggcgccctgctccaggagcacctccgagagcacagcggccctgggctgcctggtcaaggactacttccagacgtatca

SEQ ID NO: 786147 - DNA, 467 bp, Homo sapiens
  misc_feature: NA.12.30.C08.1.454.heavy.3.nb
aagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtcccccagggaagggcctggagtggattgggtacatctatcacagtgggagcacctactacatcccgtccctgaagagtcgaattacgatgtcagtaaacacgtctaggaaccagttctccctgaagctgaggtctgtgactgccgcagacacggccgtctactactgtgccaggtgggctttgcgccagtggttcagagatgatcgcttcgattcgtggggccagggaattcg

SEQ ID NO: 786148 - DNA, 627 bp, Homo sapiens
  misc_feature: NA.13.79.H02.1.454.heavy.3.nb
agggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagattggggcggaaggtatagcagtggcacgtactactttgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 786149 - DNA, 386 bp, Homo sapiens
  misc_feature: NA.40.26.C04.1.454.heavy.3.nb
ctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcga

SEQ ID NO: 786150 - DNA, 439 bp, Homo sapiens
  misc_feature: NA.14.58.F03.1.454.heavy.3.nb
aagggaaaggggctgggagaggagcccagcactagaagtcggcggtgtttccattcggtgatcagcactgaacacagaggactcactatggagtttgggctgagctgggttttcctcgctgctcttttaagaggtgtccagtgtgaggtgcagctggtggagtctgggggaggcgtggtccagcctgggaggtccctgagactctcctgtgcagcctctggattcaccttcgataattatgacatagactgggtccgccaggctccaggcagggggctggagtgggtggcaataatatcatatgatgggagcaataaatattatgaagactctgtgaagggccgattcaccatctccagagacaattccaagaacacggtatatttggaaatgaacagcctgagaggtgacgacacggctgtgtattattgtgcgaaag

SEQ ID NO: 786151 - DNA, 570 bp, Homo sapiens
  misc_feature: NA.49.46.E02.1.454.heavy.3.nb
ctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 786152 - DNA, 451 bp, Homo sapiens
  misc_feature: NA.53.57.F02.1.454.heavy.3.nb
ttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggac

SEQ ID NO: 786153 - DNA, 488 bp, Homo sapiens
  misc_feature: NA.14.35.D02.1.454.heavy.3.nb
ttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccatcggtcttccccctggcaccctcctccaagagcacctctgggggcacagcggccctgggctgcctggtcaaggactacttccg

SEQ ID NO: 786154 - DNA, 469 bp, Homo sapiens
  misc_feature: NA.16.21.B10.1.454.heavy.3.nb
ggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 786155 - DNA, 445 bp, Homo sapiens
  misc_feature: NA.17.86.H09.1.454.heavy.3.nb
ttgggtttggggtctgggagaggagccccagccctgagattcccaggtgtttccattcagtgatcagcactgaacacagaggactcaccatggagttgggactgagctggattttccttttggctactctaaaaggtgtccagtgtgaagtgcagctggtggagtctgggggaggcttggtacagcctggcaggtccctgagactctcctgtgcagcctctggattcacctttgatgattatggcatgcactgggtccgccaagccccagggaagggcctggagtgggtctcaggcattagttggaatggtggtagcatagcctatgcggactccgtgaagggccgattcaccatctccagagacaacgccgaaaattccctgtatctgcagatgaacagtctgagagctgaagacacggccttatatttctgtgtgaaaccatc

SEQ ID NO: 786156 - DNA, 491 bp, Homo sapiens
  misc_feature: NA.12.12.B01.1.454.heavy.3.nb
tccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaacacttttttgactattggggccagggaatcctggtcaccgtcgcctcagcctccaccaagggcccatcggtcttcccccg

SEQ ID NO: 786157 - DNA, 632 bp, Homo sapiens
  misc_feature: NA.3.17.B06.1.454.heavy.3.nb
gggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattcgcggtgggtctactggggccagggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 786158 - DNA, 472 bp, Homo sapiens
  misc_feature: NA.53.70.G04.1.454.heavy.3.nb
tggagtctgggggagacttgatacagcctggcaggtccctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacggtcaccgtctcctcagcctccaccaagggcccatcggtcttccccctggcgccctgctccaggagcacctccgagagcacagcggccctgggctgcctggtcaaggactacttcctcgtactgcg

SEQ ID NO: 786159 - DNA, 470 bp, Homo sapiens
  misc_feature: NA.4.23.C01.1.454.heavy.3.nb
tagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattgggccgacggaaaccttgactactggggccagggaaccctggtcaccgt

SEQ ID NO: 786160 - DNA, 599 bp, Homo sapiens
  misc_feature: NA.40.33.C11.1.454.heavy.3.nb
ttgggtttgggggagccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaaagtggggactaatgaatatggtgtggacgtctggggccaagggaccacggtcgtcgcctcttatgcctccaccaagggcccatcggtcttcccctggcgccctgctccaggagcacctccgagagcacagcggccctgggctgcctggtcaaggactacttccagtcgctaga

SEQ ID NO: 786161 - DNA, 490 bp, Homo sapiens
  misc_feature: NA.48.5.A05.1.454.heavy.3.nb
agggggctctgagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctatttctgcaaatgaacagcctgagagtcgacgacacggccgtatactactgtgcgagacagatgctgccgcctgttccgtggggccagggaaccctggtcaccgtctcctcacg

SEQ ID NO: 786162 - DNA, 615 bp, Homo sapiens
  misc_feature: NA.14.78.H01.1.454.heavy.3.nb
agctctgggagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttggggcttttgaccactggggccagggaaccctggtcaccgtctcttcagcctccaccaagggcccatcggtcttcccctggcaccctcctccaagagcacctctgggggcacagcggccctgggctgcctggtcaaggactacttccgtactagacg

SEQ ID NO: 786163 - DNA, 477 bp, Homo sapiens
  misc_feature: NA.3.82.H05.1.454.heavy.3.nb
ctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgt

SEQ ID NO: 786164 - DNA, 623 bp, Homo sapiens
  misc_feature: NA.53.33.C11.1.454.heavy.3.nb
ttgggtttggggctctgggagacgagcccagcactggaagtcgccggtgtttccattcggtgatcatcactgaacacagaggactcaccatgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctggcgccctgctccaggagcacctctgggggcacagcggccctgggctgcctggtcaaggactacttcctcgtact

SEQ ID NO: 786165 - DNA, 448 bp, Homo sapiens
  misc_feature: NA.40.2.A02.1.454.heavy.3.nb
aggggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtaacttttggatgacgtgggtccgccaggctccagggaaggggctggagtgggtggccaacataaaagcaaatggacgtctgcaaaactatgtggactctgtgaagggccgattcaccatttccagagacaacgccaagaactcactgtttctgcaaatgaacagcctgagagccgaggacacggctgtatattactgtgcgagagatgcggggggtcc

SEQ ID NO: 786166 - DNA, 462 bp, Homo sapiens
  misc_feature: NA.15.55.E11.1.454.heavy.3.nb
ttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctggcaccctcctccaagagcacctctgggggcacagcggccctgggctgcctggtcaaggactacttccgctacgtaga

SEQ ID NO: 786167 - DNA, 341 bp, Homo sapiens
  misc_feature: NA.18.31.C09.1.454.heavy.3.nb
ctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 786168 - DNA, 460 bp, Homo sapiens
  misc_feature: NA.53.4.A04.1.454.heavy.3.nb
aggggagctctgggagacgagcccagcactggaagtcgccggtgtttccattcggtgatcatcactgaacacagaggactcaccatggagtttgggctgagctgggttttcctcgttgctgttttaagaggtgtccagtgtcaggtgcatctggtggagtctgggggaggcgtggtccagcctggggggtccctgagactctcctgtgcagcctctggattcaccttcagtacctatcctattcactgggtccgccaggctccaggcaagggcctggagtgggtggcacttatatcatatgatggaggtgataaatactacgcagactccgtgaagggccgattcgccatctccagagacaattccaagaacaccctctatctacaaatgaagagactgagacctgaggacacggctgtctattactgtgcgagagtcggctttagagatgcctacaaga

SEQ ID NO: 786169 - DNA, 488 bp, Homo sapiens
  misc_feature: NA.48.76.G10.1.454.heavy.3.nb
aggggagctctgggagaggagccccagccgtgagattcccaggagttttcacttggtgatcagccctgaaaacagaccaccaaccatggagtttgggcttaactgggttttccttgttgctattttaaaaggtgcccaatgtgaggtgcagctggtggagtctgggggagccttggtacagccaggggggtccctgagactctcctgttcaacttctggattcacctttggtgattatattatgagttgggtccgccaggcgccagggaaggcactggagtgggttgctttcattagtcccaaactttctggtgggacagcatactacgccccgccagaatatgccgcgtctgtgcaaggcagattcaccatgtcaagagatgaatccaaaggtatcgcctatctgcaaatgaacagcctgaaaaccgaggacacagccgtctattactgtactagagcctattttgtacatctggtgtattcacctt

SEQ ID NO: 786170 - DNA, 609 bp, Homo sapiens
  misc_feature: NA.8.25.C03.1.454.heavy.3.nb
agctctgggagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactctgggggaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaaatgacctctggggccagggaaccctggtcaccgtctcctcagcctccaccaagggcccatcggtcttcccctggcgccctgctccaggagcacctccgagagcacagcggccctgggctgcctggtcaaggactacttccgacacgcgag

SEQ ID NO: 786171 - DNA, 591 bp, Homo sapiens
  misc_feature: NA.2.33.C11.1.454.heavy.3.nb
ttgggtttgggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttcccctggcgccctgctccaggagcacctccgagagcacagcggccctgggctgcctggtcaaggactacttcctgtcgagcgt

SEQ ID NO: 786172 - DNA, 399 bp, Homo sapiens
  misc_feature: NA.51.57.F02.1.454.heavy.3.nb
ttgggtttggggtctgggagacgagcccagcactggaagtcgccggtgtttccattcggtgatcatcactgaacacaggaccatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgag

SEQ ID NO: 786173 - DNA, 472 bp, Homo sapiens
  misc_feature: NA.15.1.A01.1.454.heavy.3.nb
agggtcttcgtggctcacgtccaccaccacgcatgtgacctcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggccactggggccagggaaccctggtcatcgtctcgtcagcctccaccaagggcccatcggtcttccccctggcaccctcctccaagagcacctctgggggcacagcggccctgggctgcctggtcaaggactacttccgctacgtaga

SEQ ID NO: 786174 - DNA, 410 bp, Homo sapiens
  misc_feature: NA.40.75.G09.1.454.heavy.3.nb
aggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtg

SEQ ID NO: 786175 - DNA, 428 bp, Homo sapiens
  misc_feature: NA.48.49.E05.1.454.heavy.3.nb
aacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtgtattattgtgcgagag

SEQ ID NO: 786176 - DNA, 463 bp, Homo sapiens
  misc_feature: NA.40.55.E11.1.454.heavy.3.nb
ttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgt

SEQ ID NO: 786177 - DNA, 459 bp, Homo sapiens
  misc_feature: NA.7.85.H08.1.454.heavy.3.nb
tcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccacctccagagacgacgccaagaactcactgtctctgcaaatgaacagcctgagagtcgaggacacggctgtgtattactgtgcgagagatccggaggggacgtatgacc

SEQ ID NO: 786178 - DNA, 411 bp, Homo sapiens
  misc_feature: NA.52.6.A06.1.454.heavy.3.nb
agggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggctggtccagcctgggaggtccctgagactctcctgtgcaggctctgcatttcccttcagtaactatgctatcgattgggtccgccaggctccaggcaagggactggagtgggtggcagttatatcagctgatggaggcaataagtattacgcagattctgcgaggggccgattcaccatatccagagacaactcccaagatatgatatatctgcaaatgaacagcctgagacctgaggacac

SEQ ID NO: 786179 - DNA, 527 bp, Homo sapiens
  misc_feature: NA.51.6.A06.1.454.heavy.3.nb
agggggctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggactgcagtgggtggcatctatatcatatgaaggaagcaataaatactacgcagactccgtgaagggccgattcaccatctccagagacaatcccaagaacacactttatctgcaaatgaacaccctgagacttgaggacacggctgtctattattgtgcgagagggagatcgatcacagcagccctcgaagaccagcatgatggttttgatgtctggggccaagggacaatggtcaccgtctcttcagcctccacc

SEQ ID NO: 786180 - DNA, 473 bp, Homo sapiens
  misc_feature: NA.51.75.G09.1.454.heavy.3.nb
aggggagctctgagagaggagcccagccctgggattttcaggtgttttcatttggtgaccaggactgaacagagagaactcaccatggaggttgggctgagttggctttttcttgtggctattttaaaaggtgtccagtgtgaggtgcagttgttggagtctgggggaggcttggtacagcctggggggtccctgagactctcctgtgcagcctctggaatcacctttaggaattatgccatgacgtgggtccgccaggctccaggaaggggctggagtgggtctcgactattagtggtagtggtggtaggacatactacgcagactccgtcaagggccggttcaccatctccagagacaattccgagaactcggtgtctctgcaaatgagcagcctgagagccgaggacacggccgtatatttctgtgcgaaagacttcggacaactggaagtacgtatgttcgcattcagc

SEQ ID NO: 786181 - DNA, 585 bp, Homo sapiens
  misc_feature: NA.48.39.D06.1.454.heavy.3.nb
cagttctttggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 786182 - DNA, 477 bp, Homo sapiens
  misc_feature: NA.51.79.H02.1.454.heavy.3.nb
agggaaaggggactttctgagactcatggacctcctgcacaagaacaagaaacacctgtggttcttcctcctcctggtggcagctcccagatgggtcctctctcaggtgcagctgcaggagtcgggcccaggactggtgaagccttcggggaccctgtccctcacctgcgctgtctctggtgtctccatccgcagtcctaattggtggagttgggtccgtcagcccccagggaagcggctggagtggattggggaaatctatcatactgagaacaccaactacaacccgtccctcgagagtcgagtcaccatgtcaatagacaagggcaacaatgagttctccctgaatctgcggtctgtgaccgccgcggacacggccgtgtattattgtgtgagagatcggcaagatagtagtggttattacatcggtgactacgacggtatggacgtctggggccaagggaccacggtcatcgt

SEQ ID NO: 786183 - DNA, 615 bp, Homo sapiens
  misc_feature: NA.47.38.D05.1.454.heavy.3.nb
ttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 786184 - DNA, 479 bp, Homo sapiens
  misc_feature: NA.16.86.H09.1.454.heavy.3.nb
tgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccagggaagcttggtcaccgtctcctcagcct

SEQ ID NO: 786185 - DNA, 539 bp, Homo sapiens
  misc_feature: NA.26.71.G05.1.454.heavy.3.nb
actcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttcccctggcgccctgctccaggagcacctccgagagcacagcggccctgggctgcctggtcaaggactacttcct

SEQ ID NO: 786186 - DNA, 513 bp, Homo sapiens
  misc_feature: NA.51.83.H06.1.454.heavy.3.nb
tcgcggggctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaaacacgctgtatctccaaatgaacagcctcagatctgaggacacggctatctactactgtgtgaaagaattgggtttcagtggctactttgacttctggggccagggaaccctggtcaccgtctcctcagcttccaccaaggg

SEQ ID NO: 786187 - DNA, 474 bp, Homo sapiens
  misc_feature: NA.13.21.B10.1.454.heavy.3.nb
aagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggaaccctggtcaccgtcaac

SEQ ID NO: 786188 - DNA, 369 bp, Homo sapiens
  misc_feature: NA.9.11.A11.1.454.heavy.3.nb
agggaagggcctggagtacattggggacatctatgccactgggagcaccgactacaacccgtccctcgagagtcgactctccatgtcccttgacacgtctaagaaccagtattccctgcaactgagctccgtgactgccgctgacacggccgtttattactgtgccataacagcctgtattactaccagttgctatcatctgagtccggacagctactttgtctcctggggcctgggaaccctggtcaccgtctcctcagcctccaccaagggcccatcggtcttccccctggcaccctcctccaagagcacctctgggggcacagcggccctgggctgcctggtcaaggactacttccagacgtatca

SEQ ID NO: 786189 - DNA, 414 bp, Homo sapiens
  misc_feature: NA.48.21.B10.1.454.heavy.3.nb
agggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttt

SEQ ID NO: 786190 - DNA, 634 bp, Homo sapiens
  misc_feature: NA.52.78.H01.1.454.heavy.3.nb
cgatgaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactacttcctatacgatcg

SEQ ID NO: 786191 - DNA, 498 bp, Homo sapiens
  misc_feature: NA.12.14.B03.1.454.heavy.3.nb
tccgcggggagctctgggagaggagccccagccctgagattcccaggtgtttccattcagtgatcaacactgaacacagaggactcatcatggaattgggactgacctgcattttccttttggctattttaaagggtgtccagtgtgaagtgcacttggaacagtcggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctgggcccagggaaccctggtcgcgg

SEQ ID NO: 786192 - DNA, 623 bp, Homo sapiens
  misc_feature: NA.53.25.C03.1.454.heavy.3.nb
agctctgagagaggagccttagccctggattccaaggcctctccacttggtgatcagcacttagcaccgaggattcaccatggaactggggctccgctgggttttccttgttgcttttttagaaggtgtccagtgtgacatgcagctggtggagtctgggggaggcctggtcaagccgggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgcttttgatgtctggggccaagggacaatagtcaccgtctcttcagcctccaccaagggcccatcggtcttcccctggcaccctcctccaagagcacctctgggggcacagcggccctgggctgcctggtcaaggactacttcctcgtactgcg

SEQ ID NO: 786193 - DNA, 428 bp, Homo sapiens
  misc_feature: NA.14.70.G04.1.454.heavy.3.nb
tccctaaaactctcctgtacaacctcaggattcgcctttcgcatctatgccatggcctgggtccgccagattccagggaaggggctggagtggatctcaactattagtggaagtgggagtggtgaatccacatattacgcaggctctgtgaagggccggttcaccatctccagagacaattccaacaacacactttatctgcaaatgaacagcctgcgagccgaggacacggccctatattactgtgcaagagatcgaacaggcccgtgggagcccgttgactactggggccagggaaccctagtcatcgtctcctcagcctccaccaagggcccatcggtcttccccctggcaccctcctccaagagcacctctgggggcacagcggccctgggctgcctggtcaaggactacttccgtactagacg

SEQ ID NO: 786194 - DNA, 493 bp, Homo sapiens
  misc_feature: NA.22.38.D05.1.454.heavy.3.nb
ttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaaccctggtcaccgtctcctcagcctccaccaagggcccatcggtcttcccctc

SEQ ID NO: 786195 - DNA, 488 bp, Homo sapiens
  misc_feature: NA.11.85.H08.1.454.heavy.3.nb
tcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaaccctggtcaccgtctcctcagcctccaccaagggcccatcggtcttcccctggcaccctcctcc

SEQ ID NO: 786196 - DNA, 463 bp, Homo sapiens
  misc_feature: NA.11.71.G05.1.454.heavy.3.nb
agctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgacgtacgggggcgttcg

SEQ ID NO: 786197 - DNA, 464 bp, Homo sapiens
  misc_feature: NA.2.53.E09.1.454.heavy.3.nb
ttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgcttacaacggtaacacaaactatgcacagaagttccagggcagagtcaccctgaccacagacacatccacgagcacagtcaacctggacctgaggagcctgacatctgacgacacggccgtgtattattgtgcgagaggacggagggggggagcgacgccttttgactacgtggggccagggaaccctggtcaccgtctcctcagcctccaccaa

SEQ ID NO: 786198 - DNA, 498 bp, Homo sapiens
  misc_feature: NA.49.67.G01.1.454.heavy.3.nb
ttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccagggaaccccggtcaccgtctcctctgcctccaccaagggcccatcggtc

SEQ ID NO: 786199 - DNA, 438 bp, Homo sapiens
  misc_feature: NA.53.55.E11.1.454.heavy.3.nb
ttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgtttattattgtgtgagagagg

SEQ ID NO: 786200 - DNA, 444 bp, Homo sapiens
  misc_feature: NA.11.81.H04.1.454.heavy.3.nb
ctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcctgtgcagcgtctggattcaccttcaggagctatgacatgcactgggtccgccaggctccaggcaaggggctggagtgggtggcagttatatggtatgatggaagttataaatactatggagactccgtgaagggccgattcaccatctccagagacacttccaagaacacggtgtatctgcaaatgaacagcctgagagccgaggacacgg

SEQ ID NO: 786201 - DNA, 456 bp, Homo sapiens
  misc_feature: NA.49.11.A11.1.454.heavy.3.nb
ctctgggagaggagccccagccttgggattcccaagtgttttcattcagtgatcaggactgaacacagaggactcaccatggagtttgggctgacctggattttccttgctgctattttaaaaggtgtccagtgtcaggtccagctggtggagtctgggggaggcttggtaaggcctggggggtcccttagactctcctgtgcagcctctggattcaatttcaatgacgcctggatgagctgggtccgacaggctccagggaaggggctggagtgggttgcccgtattaaaagcagagttgatggtgggacaagagagtacgctgcgaccgtgaaaggcagagtcagcatctcaagagatgattcaagagacacggtgtttctgcaattgaccagcctgaaaacggaggacacagccgtgtattactgtgccacgtggcaccatggatacgcctat

SEQ ID NO: 786202 - DNA, 371 bp, Homo sapiens
  misc_feature: NA.16.78.H01.1.454.heavy.3.nb
ctcaactctcttgtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 786203 - DNA, 434 bp, Homo sapiens
  misc_feature: NA.10.26.C04.1.454.heavy.3.nb
aaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgag

SEQ ID NO: 786204 - DNA, 484 bp, Homo sapiens
  misc_feature: NA.16.27.C05.1.454.heavy.3.nb
agggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccggggagccccggtcatcgtct

SEQ ID NO: 786205 - DNA, 581 bp, Homo sapiens
  misc_feature: NA.52.15.B04.1.454.heavy.3.nb
tccgcggggagctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgctgattctgcgaggggccgattcaccatatccagagacaactcccaagatgtgatatatctacaaatgaacagcctgagacctgaggacacggctgtatattattgtgcgtcagggggcagtgcctggccacgtgatgcttttgatttctggggccaagggacattcgtcaccgtctcctcagcctccaccaagggcccatcggtcttcccctggcaccctcctccaagagcacctctgggggcacagcggccct

SEQ ID NO: 786206 - DNA, 517 bp, Homo sapiens
  misc_feature: NA.13.88.H11.1.454.heavy.3.nb
aacacacaaaggggccgggagaggagccccagccctgggattcccaagtgttttcattcagtgatcaggactgaacacagaggactcaccatggagtttgggctgagctggattttccttggtgtttttttaaaaggtgtccactgtgagctgcagctggtggagtctggggggggcttggtaaagcctggggggtcccttacactctcctgtgtagcctctaaaatcactttcaacgacgcctggatgagctgggtccgccaggcgccagggaggggactggagtgggttggccgtattaaaagcgaggccgatggtgggacagcagacttcgctgcacccgtgcaagccagattcaccctctcaagacatgatttagagaatactgtgtatttgcaaatgaacagcttgacaaccgaggacgcaggcgtttattactgtgccagtagttccacctggccactctacttctttgacttctggggccagggaaccctggtcgccgtctcctcagctt

SEQ ID NO: 786207 - DNA, 624 bp, Homo sapiens
  misc_feature: NA.15.86.H09.1.454.heavy.3.nb
ttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggaagattcaccatctcaagagataattcaaaacgacggtgtatttgcaaatgaacagcctgaaaaccgaggacacagccgtctattactgtaccacagattcggaagtgcatcgacgtaaaggaggctatgcttttgatatctggggcccagggacaatggtcgtcgtctcttcagcctccaccaagggcccatcggtcttcccctggcaccctcctccaagagcacctctgggggcacagcggccctgggctgcctggtcaaggactacttccgctacg

SEQ ID NO: 786208 - DNA, 332 bp, Homo sapiens
  misc_feature: NA.22.46.E02.1.454.heavy.3.nb
ctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaaggactacttccagacgtatgt

SEQ ID NO: 786209 - DNA, 458 bp, Homo sapiens
  misc_feature: NA.52.54.E10.1.454.heavy.3.nb
aacacacaaaggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatcttttactgtgcgagagggaactcgattacagca

SEQ ID NO: 786210 - DNA, 464 bp, Homo sapiens
  misc_feature: NA.10.44.D11.1.454.heavy.3.nb
agggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctggggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagttccaagtactcc

SEQ ID NO: 786211 - DNA, 463 bp, Homo sapiens
  misc_feature: NA.12.53.E09.1.454.heavy.3.nb
ttggggggagatgtggtccggcctggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttcccctggcaccctcctccaagagcacctctgggggcacagcggccctgggctgcctggtcaaggactacttcctacgtcgtat

SEQ ID NO: 786212 - DNA, 635 bp, Homo sapiens
  misc_feature: NA.51.86.H09.1.454.heavy.3.nb
ttgggtttggggtctgggagacgagcccagcactggaagtcgccggtgtttccattcggtgatcatcaccgaacacagaggactcaccatggagtttggactgagctgggttttcctcgttgctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaaattatgcagactccgtgaagggccgattcaccatctccagagacaattccaagaacactctatatttgcagatgaatagcctgagaattgaggacacggctgtgtattactgtgtgagagggtcggcatattccggtttttggagtaattatctactgggaacttttgatatctggggccacgggacaatggtcaccgtctcttcagcttccaccaagggcccatcggtcttcccctggcgccctgctccaggagcacctctgggggcacagcggccctgggctgcctggtcaaggactacttcctcgtagcact

SEQ ID NO: 786213 - DNA, 420 bp, Homo sapiens
  misc_feature: NA.10.77.G11.1.454.heavy.3.nb
aagggaaagggtgtacacctgtggttctcggggctgccctttggctttggagatggttttctcgaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttccccctggcaccctcctccaagagcacctctgggggcacagcggccctgggctgcctggtcaaggactacttcccactactatg

SEQ ID NO: 786214 - DNA, 416 bp, Homo sapiens
  misc_feature: NA.7.34.D01.1.454.heavy.3.nb
ttgggtttgggattcacgttgcagatgtaggtctgggtgcgccagatgcccgggaaaggcctggagtggatggggagcatctatcctggtgactctgataccagatacagcccgtccttccaaggccacgtcaccatctcgctcgacaagtccatcaccaccgcctacgtggagtggagcagcctgaaggcctcggacaccgcaatgtattactgtgcgaaactcgaccgagattgtcgtggtggcaggtgcttctcggaaaaattcgagtcctggggccagggaaccccggtcagtgtctcctcagcctccaccaagggcccatcggtcttccccctggcaccctcctccaagagcacctctgggggcacagcggccctgggctgcctggtcaaggactacttcctagagacacg

SEQ ID NO: 786215 - DNA, 470 bp, Homo sapiens
  misc_feature: NA.49.19.B08.1.454.heavy.3.nb
agggggctctgagagaggagcccagccctgggattttcaggtgttttcatgtggtgatcaggactgaacagagagaactcaccatggagtctgggctgacgtggcttttgcttgtggctatcttaaaaggtgtccagtgtgacgtgcagttggtggagtcggggggaggcttggtacagccgggggggtccctgagactctcctgtacagtctctggcttcacctttagagtctatgacatgagttgggtccgccaggctccggggaaggggctggagtgggtctcaacgatcagtgatagtggaactaagacaaactatgccgactccgtgaagggccgatgcaccatctccagagacaactcgaaggacactttatatctgcaactcaacagactgacaaccgcggacgcggccgtctattactgtgtgaaagaagacggaccgctggacgaggagccagaggaaaat

SEQ ID NO: 786216 - DNA, 350 bp, Homo sapiens
  misc_feature: NA.13.72.G06.1.454.heavy.3.nb
ctgcagtgggtcgccactattggtgataatggcagaaacatttactacgcagactccgtgaggggccgcttcaccatctccagagacaattcacggaacacattgtttttacaaattgtcggcctgcgggccgaggacacggccaaatatttttgtgtaaaggatcaatataccagtttggttcgaagtccgtggccttttgactcctggggccagggaaccctggtcaccgtctcctcagcttccaccaagggcccatcggtcttccccctggcgccctgctccaggagcacctctgggggcacagcggccctgggctgcctggtcaaggactacttcctagtacgtga

SEQ ID NO: 786217 - DNA, 477 bp, Homo sapiens
  misc_feature: NA.13.26.C04.1.454.heavy.3.nb
acccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttggggcgcggactcctcttgagatctggggccagggggacaatggtcaccgtctcttcacg

SEQ ID NO: 786218 - DNA, 407 bp, Homo sapiens
  misc_feature: NA.51.69.G03.1.454.heavy.3.nb
ctgggagaggagccccagccctgagattcccaggtgtttccattcagtgatcagcactgaacacagaggactcaccatggagttgggactgagctggattttccttttggctattttaaaaggtgtccagtgtgaagtgcagctggtggaatctgggggaggcttggtacagcctggcaggtccctgagactctcctgtgcggtctctggattcacctttgatgattatgccatgcactgggtccggcaagctccagggaagggcctggagtgggtctcaggtattaactgggatggtggaagcattgggtatgcggactctgtgaggggccgattcaccatctccagagacaacgccaagaactccctgtatctgcaaatggacagtctgagagctgaggacacgg

SEQ ID NO: 786219 - DNA, 441 bp, Homo sapiens
  misc_feature: NA.22.78.H01.1.454.heavy.3.nb
tcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaacggctattactacggatttgacacctggggccagggaaccctggtcaccgtctcctcagcctccaccaagggcccatcggtcttccccctggcaccctcctccaagagcacctctgggggcacagcggccctgggctgcctggtcaaggactacttccacgacgtatgt

SEQ ID NO: 786220 - DNA, 593 bp, Homo sapiens
  misc_feature: NA.53.36.D03.1.454.heavy.3.nb
atctctcttgggggctctgggagaggagccccagccgtgagattcccaggagtttccacttggtgatcagcactgaacacagaccaccaaccatggagtttgggcttagctgggttttccttgttgctattttaaaaggtgtccaatgtgaggtggaactggtggagtcttgggggaggcttggttcagccagggcggtccctgagactctcctgtacaacttcaggattcacctttggtgattatgctatgacctgggtccgccaggctccagggaaggggctggagtgggtaggtttcgttagaagcaaaactgatggtgggacaacagaatacgccgcgtctgtgaaaggcagatttatcatctcaagagatgattccagaggcatcgcctatctgcaaatgaacagcctgaaaaccgaggacacagccgtgtatttctgtactagagtcttcttgtattactatgatactagtggttatacaggagtggggcacggtatggacgtctggggccaagggaccacggtcaccgtctcctcagcctccaccaagggcccatcggtcttcccctggcaccctcctccaagagc

SEQ ID NO: 786221 - DNA, 575 bp, Homo sapiens
  misc_feature: NA.40.31.C09.1.454.heavy.3.nb
agggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggcccgggctgcctggtcaaggactacttccagtcgctaga

SEQ ID NO: 786222 - DNA, 468 bp, Homo sapiens
  misc_feature: NA.52.1.A01.1.454.heavy.3.nb
agggggctttctgagagtcatggacctcctgtgcaagaacatgaagcacctgtggtttttcctcctgctggtggcagctcccagatgggtcctgtcccacgtgcagctgcaggagtcgggcccaggactggtgaagccttcggagatcatgtccctcacctgctctgtctctggtgactccatcagcagtggttattactgggcctgggtccggcagcccccagggaaggggtttgagtggattgggagtatcgatcacagtgggagcacctacctgaacccgtccctcacgactcgagtcgccatatcaacagacacgtccaagaaccagttctacctgaggctgaactctgtgaccgccgcagacacggccgtatattattgtgcgcgggacttcgaggggtggatatagtggctacgattcgtatctccttgactactggggccagggaaccctggtcaccgtct

SEQ ID NO: 786223 - DNA, 612 bp, Homo sapiens
  misc_feature: NA.12.55.E11.1.454.heavy.3.nb
ttgggtttggggagacgagcccagcactggaagtcgccggtgtttccattcggtgatcatcactgaacacagaggactcaccatggagtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctgggggcacagcggccctgggctgcctggtcaaggactacttcctacgtcgtacttcc

SEQ ID NO: 786224 - DNA, 357 bp, Homo sapiens
  misc_feature: NA.4.60.F05.1.454.heavy.3.nb
gggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactactggggccagggaaccctggtcaccgtctcctcagcctccaccaagggcccatcggtcttccccctggcgccctgctccaggagcacctccgagagcacagcggccctgggctgcctggtcaaggactacttccctacagtgct

SEQ ID NO: 786225 - DNA, 456 bp, Homo sapiens
  misc_feature: NA.5.57.F02.1.454.heavy.3.nb
ttgggtttggggaactctgagagaggagcccagccctgggattttcaggtgttttcatttggtgatcaggactgaacagagcgaactcaccatggagtctgggctgacctggctttttcttgtgactattttaaaaggtgtccactgtgacgtgcagatcttggagtctgggggacgcttcgagcggccggggggatccgtgagactctcctgctcaacctctggattcacatttgtcctttacgccatgacttgggtccgccaggctccagggagggggccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcggccgagcaatactc

SEQ ID NO: 786226 - DNA, 344 bp, Homo sapiens
  misc_feature: NA.13.24.C02.1.454.heavy.3.nb
tagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 786227 - DNA, 461 bp, Homo sapiens
  misc_feature: NA.48.81.H04.1.454.heavy.3.nb
catcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactactttgaattc

SEQ ID NO: 786228 - DNA, 616 bp, Homo sapiens
  misc_feature: NA.8.38.D05.1.454.heavy.3.nb
ttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagcggccctgggctgcctggtcaaggactacttccgacacgcgag

SEQ ID NO: 786229 - DNA, 396 bp, Homo sapiens
  misc_feature: NA.3.21.B10.1.454.heavy.3.nb
aggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 786230 - DNA, 522 bp, Homo sapiens
  misc_feature: NA.9.63.F08.1.454.heavy.3.nb
agggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctgggggcacagcggccctgggctgcctggtcaaggactacttccagacgtatca

SEQ ID NO: 786231 - DNA, 454 bp, Homo sapiens
  misc_feature: NA.43.14.B03.1.454.heavy.3.nb
tccgcgggcacgaccggtgctcgatttagtgtgagtagttccgcgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtatcactg

SEQ ID NO: 786232 - DNA, 605 bp, Homo sapiens
  misc_feature: NA.10.71.G05.1.454.heavy.3.nb
agctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggtattgtgacttccggggccagggaaccgtggtcaccgtctcttcggcctccaccaagggcccatcggtcttcccctggcgccctgctccaggagcacctccgagagcacagcggccctgggctgcctggtcaaggactacttcccactactatg

SEQ ID NO: 786233 - DNA, 620 bp, Homo sapiens
  misc_feature: NA.19.17.B06.1.454.heavy.3.nb
aggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtctgggggaggcctggtcaagcctggggggtccctgcgactctcctgtgtggtctccggattcccattcagtcactatagtatgatgtgggcccgccaggctccggggaaggggctggaatggcttgcatcccttggttggagtggaattaatacacaccacgcagactcagtgaggggccggttcaccatctccagagacaacgccaagagtacaatgtatttacaaatgaacagcctgagagccgaggatacggctgtgtattattgtgcgagaatttccgagccgcactactttgactactggggccagggagccctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 786234 - DNA, 605 bp, Homo sapiens
  misc_feature: NA.47.46.E02.1.454.heavy.3.nb
agagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 786235 - DNA, 623 bp, Homo sapiens
  misc_feature: NA.49.8.A08.1.454.heavy.3.nb
agggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattccgagaacacgctgtatctgcaaatgaacagcctgagagctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 786236 - DNA, 475 bp, Homo sapiens
  misc_feature: NA.46.67.G01.1.454.heavy.3.nb
ttgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcaacccgggatactactccaccttcggcttggacatctggggccgac

SEQ ID NO: 786237 - DNA, 462 bp, Homo sapiens
  misc_feature: NA.40.65.F10.1.454.heavy.3.nb
agggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttc

SEQ ID NO: 786238 - DNA, 650 bp, Homo sapiens
  misc_feature: NA.12.11.A11.1.454.heavy.3.nb
aggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataaacagcctgaaagccgaggacacggctgtgtatttctgtgcgaggacgtcctacggtgacaaatttattcaaaccagacaaagttcgttcgccaagccgtcacactactttgacagctggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 786239 - DNA, 603 bp, Homo sapiens
  misc_feature: NA.19.67.G01.1.454.heavy.3.nb
ttgggtttgggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 786240 - DNA, 471 bp, Homo sapiens
  misc_feature: NA.11.25.C03.1.454.heavy.3.nb
agaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccac

SEQ ID NO: 786241 - DNA, 314 bp, Homo sapiens
  misc_feature: NA.2.86.H09.1.454.heavy.3.nb
ttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacataggggccggcgcgggagcgaatgacttc

SEQ ID NO: 786242 - DNA, 479 bp, Homo sapiens
  misc_feature: NA.21.53.E09.1.454.heavy.3.nb
ttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccagggaaggggctggagtgggtctcatatattagtagtagtggtagtcccgtatactacgcagactctgtgaagggccgattcaccatcgccagggacaacgccaagaactcacagtatctgcagatgaatagcctgagagccgaggactcggccgtgtattactgtgcgagagatcccggcgatgatggcgacggctggtactacttt

SEQ ID NO: 786243 - DNA, 453 bp, Homo sapiens
  misc_feature: NA.10.21.B10.1.454.heavy.3.nb
gagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggc

SEQ ID NO: 786244 - DNA, 615 bp, Homo sapiens
  misc_feature: NA.51.45.E01.1.454.heavy.3.nb
tctgggagacgagcccagcactcgaagtcgccggtgtttccattcggtgatcatcactgaacacagaggactcaccatggagtttgggctgagctgggttttcctcgttgctcttttaagaggtgtccagtgtcaggtgcggctggtggagtctgggggaggcgtggtccagcctggggattccctgagaatctcctgtgcagcctctggattcaacttcaatagacatcctatgcactgggtccgccaggctccaggcaaggggctggaatgggtggcagttatttcgtccactggaaacagtaaacattatggacgctccgtgaagggcccattcgccatctccagagacaattccaaaaataccctctatctgcgaatgaacagcctgcgacctgaagacacggctatatatttctgtgcgagaggggagtcttattgtaatgatggttcctgctatcgttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 786245 - DNA, 460 bp, Homo sapiens
  misc_feature: NA.3.63.F08.1.454.heavy.3.nb
aggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagtttgtttgggcgggatagcagcggtacc

SEQ ID NO: 786246 - DNA, 439 bp, Homo sapiens
  misc_feature: NA.14.5.A05.1.454.heavy.3.nb
agggggccccagccctgggattcccagctgtttctgcttgctgatcaggactgcacacagagaactcaccatggagtttgggctgagctgggttttccttcttgctattttaaaaggtgtccaatgtgaggtgcagctggtggagtccgggggaggcttagttcagccgggggggtccctgagactctcctgtgaaacctctggattcagcttcagtagttactggatgcactgggtccgccaagttccagcgaaggggctggtgtgggtcgcacgcattgatagtgatggcagaagcgcaagctatggggactccgtgaagggccgattcaccatctccagagacaacgccaagaacacgctgttcctgcaaatgaacagtctgagagccgacgacacggctgtatattactgtgtaagagattccgtctatggagat

SEQ ID NO: 786247 - DNA, 464 bp, Homo sapiens
  misc_feature: NA.21.35.D02.1.454.heavy.3.nb
ttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactactggggccagggaaccctggtcaccgtctcctcagcctccaccg

SEQ ID NO: 786248 - DNA, 432 bp, Homo sapiens
  misc_feature: NA.19.49.E05.1.454.heavy.3.nb
aacacacaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatatattagtagtagtggtagtaccatatactacgcagactctgtgaagggccgattcaccatctccagggacaacgccaagaactcactatatctgcaaatgaacagcctgagagccgaggacacggccgtgta

SEQ ID NO: 786249 - DNA, 457 bp, Homo sapiens
  misc_feature: NA.12.1.A01.1.454.heavy.3.nb
agggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagtggttactgttggactactttgactactggggcca

SEQ ID NO: 786250 - DNA, 464 bp, Homo sapiens
  misc_feature: NA.48.74.G08.1.454.heavy.3.nb
aggggaggtctgggagaggagccccagccctgagattcccaggtgtttccattcagtgatcagcactgaacacagaggactcaccatggagttgggactgagctggattttccttttggctcttttaacaggtgtccagtgtgaagtgcagctggtggagtctgggggaggcttggtacagcccggcaggtccctgagactctcctgtgcagcctctggattcatctttggtgattatgccatgcactgggtccggcgaattccagggaagggcctggagtgggtctcaggtattagttgggatggtgacagtataggctatgcggactctgtgaggggccgattcaccatcaccagggaaacgccaataactccctgtgtctacaaatgaacaatctgagacctgaagacacggccttgtattttgtgtaaagatattctcgacaattatggtcatcgtgggt

SEQ ID NO: 786251 - DNA, 461 bp, Homo sapiens
  misc_feature: NA.4.58.F03.1.454.heavy.3.nb
aagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctagtctgggatctagttatagtgactcgtcgttctggggccg

SEQ ID NO: 786252 - DNA, 473 bp, Homo sapiens
  misc_feature: NA.26.12.B01.1.454.heavy.3.nb
tccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatctccagagacaacgccaggaactccctctatctagaaatggacagtctgacaactgaggacacggccttttattctgtgcaaaggtggaaccgacatatttcacaagctggcactggtacttcg

SEQ ID NO: 786253 - DNA, 454 bp, Homo sapiens
  misc_feature: NA.4.21.B10.1.454.heavy.3.nb
agagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaaggactacttccctacagtgct

SEQ ID NO: 786254 - DNA, 496 bp, Homo sapiens
  misc_feature: NA.52.73.G07.1.454.heavy.3.nb
agggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgcccctggcgctatggacgtctggggccaagggaccacggtcaccgtctcctcagcctccaccaagggcccatcggtcttcccct

SEQ ID NO: 786255 - DNA, 544 bp, Homo sapiens
  misc_feature: NA.19.26.C04.1.454.heavy.3.nb
agaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccatttacggtttggacgtctggggccaagggaccacggtcatcgtctccccagcctccaccaagggcccatcggtcttcccctggcgccctgctccaggagcacc

SEQ ID NO: 786256 - DNA, 617 bp, Homo sapiens
  misc_feature: NA.48.68.G02.1.454.heavy.3.nb
ctctgggagaggagccccagccctgagattcccaggtgtttccattcagtgatcagcactgaacacagaggactcaccatggagttgggactgaactggattttccttttggctattttaaaaggtgtccagtgtgaactgcaactggtggagtctgggggaggcttggtacagcctggcaggtccctgagactctcctgtgcagcctctggattcacctttggtgattatgccatgcactgggtccggcaagctccagggaagggcctggagtgggtctcaggtattagttggaatagtgatagcataggctatgcggactctgtgaagggccgattcaccatctccagagacaacgccaagaactccctgtatctgcaaatgaacagtctgagaactgaggacacggccttgtattactgtgtaaaagatatgatttttggggttcggggagttggaggcggtcttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 786257 - DNA, 453 bp, Homo sapiens
  misc_feature: NA.11.72.G06.1.454.heavy.3.nb
acccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctggttcgacctctggggccac

SEQ ID NO: 786258 - DNA, 629 bp, Homo sapiens
  misc_feature: NA.15.67.G01.1.454.heavy.3.nb
ttgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggtatgatgcttttgatatgtggggccaagggacagtggtcaccgtcacttcagcctccaccaagggcccatcggtcttcccctggcgccctgctccaggagcacctccgagagcacagcggccctgggctgcctggtcaaggactacttccgctacgtaga

SEQ ID NO: 786259 - DNA, 465 bp, Homo sapiens
  misc_feature: NA.53.81.H04.1.454.heavy.3.nb
agctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaacagcctgagagctgaggacacggctctttattactgtgcgagagattctggatacagccattattacttgcccggcta

SEQ ID NO: 786260 - DNA, 470 bp, Homo sapiens
  misc_feature: NA.48.22.B11.1.454.heavy.3.nb
aggggagctctgggagaggagctccagccttgggattcccagctgtctccactcggtgatcggcactgaatacaggagactcaccatggagtttgggctgaactgggttttccttgttgctattttaaaaggtgtccagtgtgaggtgcagctggtggagtccgggggagccttggttcagcctggggggtctctgaaactctcctgtgcagcctctgggttcatgttcaatgtctctgctattcactgggtccgccaggcttccgggaaagggctggaatgggttggtcgtattagaactaaagtaaatagttacgcgacagcagatgctgcgtcggtgaaaggcaggttcaccatctccagagatgattcaaagaacacggcgtatctgcaaatgaacagcctgaaaaccgaggacacggccatttatttttgtgctagatctgaagaattaccagctgctgtgttct

SEQ ID NO: 786261 - DNA, 359 bp, Homo sapiens
  misc_feature: NA.47.24.C02.1.454.heavy.3.nb
tagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 786262 - DNA, 350 bp, Homo sapiens
  misc_feature: NA.40.58.F03.1.454.heavy.3.nb
aagggaaaggggctggagtgggttggccgtgttaagaccaaacctgagggtggggcaatagactacgctgcacccgtgacaggcagattcgccatctcaagagatgattcagcaggcacggtgtatctggaaatgaacagcctgaaagccgaggacacagccgtgtattattgtaccgcagggctcggctactccgatactgactattggggccagggaaccctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 786263 - DNA, 645 bp, Homo sapiens
  misc_feature: NA.22.85.H08.1.454.heavy.3.nb
acgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttggggttttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtct

SEQ ID NO: 786264 - DNA, 428 bp, Homo sapiens
  misc_feature: NA.48.52.E08.1.454.heavy.3.nb
agagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcg

SEQ ID NO: 786265 - DNA, 591 bp, Homo sapiens
  misc_feature: NA.12.5.A05.1.454.heavy.3.nb
agggagaggctcttctgtgtgtagtggttgtgcagagcctcatgcatcacggagcatgagaagacgttcccctgctgccacctgctcttgtccacggtgagcttgctgtagaggaagaaggagccgtcggagtccagcatgggaggcgtggtccaacctggaaagtccctgagcctctcctgtgcagcctctggattcacattcagtacccgtgctatgcagtgggtgcgccaggctccaggcaaggggctggactgggtggccgttatagcacctgatggcaatgtgaagtattatgcagactccgtgaggggccgattcacgatcttaagagacaattcgaagaacactctgtatctacagatggacagcctgagagttgaagacacggctctttattactgtgcgagagagaattacgatttgactctcggtgctcttgatatctggggcctagggacaatggtcaccgtctcctcagcctccaccaagggcccatcggtcttccccctggcgccctgctccaggagcacctccgagagcacagcggccctgggctgccctggtcaaggactacttcctacgtcgtat

SEQ ID NO: 786266 - DNA, 465 bp, Homo sapiens
  misc_feature: NA.51.56.F01.1.454.heavy.3.nb
aacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgacatttgacgacacggccgtctattactgtgcgacagaagcggcggacagaggttcgcttactggttcgaggct

SEQ ID NO: 786267 - DNA, 626 bp, Homo sapiens
  misc_feature: NA.8.34.D01.1.454.heavy.3.nb
ttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccagcgggagttccaagtactcctttgacgtctggggccagggtaccctggtcaccgtctcctcagcctccaccaagggcccatcggtcttccccctggcgccctgctccaggagcacctccgagagcacagcggccctgggctgcctggtcaaggactacttccgacacgcgag

SEQ ID NO: 786268 - DNA, 391 bp, Homo sapiens
  misc_feature: NA.11.39.D06.1.454.heavy.3.nb
cagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 786269 - DNA, 457 bp, Homo sapiens
  misc_feature: NA.19.1.A01.1.454.heavy.3.nb
aggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggaggaagcatccctttctttgatactccagactacgcacagaagttccagggcagagtcacgattaccgcggacgaatccacgagcacagtctatatggaattgaccagcctgacatcagaggacacggccgtctatttttgtgcgacagaaagagattccatactcaggcggggcactatggcagcagctg

SEQ ID NO: 786270 - DNA, 436 bp, Homo sapiens
  misc_feature: NA.49.75.G09.1.454.heavy.3.nb
agggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgcttcatcatctccagagacaactccgagaacacgctgtatctgcaaatgaacaggctgagagttgaagacacggctgtatattactgtgcgaactta

SEQ ID NO: 786271 - DNA, 455 bp, Homo sapiens
  misc_feature: NA.49.85.H08.1.454.heavy.3.nb
tcgcggggagtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcagcttctctgggttctcactctccagtcctggagtgggtgtgggctggatccgtcagcccccaggaaaggccctggagtggcttgcactcatttattggaatgacgataagacctacagcccatctctgaagagcaggctcaccatcaccaaggacacctccaacaaccaggtggtccttacaatgaccaacatggaccctgtggacacagccacatattactgtgcacacgtccccccgccgtacttattatgatgctagtggttattccaacgctgaatacttccagcactggggccagggc

SEQ ID NO: 786272 - DNA, 568 bp, Homo sapiens
  misc_feature: NA.10.53.E09.1.454.heavy.3.nb
ttgggttttgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactggggccagggcaccctggtcaccgtctcctcagcctccaccaagggcccatcggtcttcccctggcaccctcctccaagagcacctctgggggcacagcgg

SEQ ID NO: 786273 - DNA, 440 bp, Homo sapiens
  misc_feature: NA.53.22.B11.1.454.heavy.3.nb
agggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaact

SEQ ID NO: 786274 - DNA, 443 bp, Homo sapiens
  misc_feature: NA.49.20.B09.1.454.heavy.3.nb
aggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttattactgtgcgagagggaagtgggatattgtggcagctccaggtgcccag

SEQ ID NO: 786275 - DNA, 461 bp, Homo sapiens
  misc_feature: NA.52.22.B11.1.454.heavy.3.nb
aggggtgggagaggagccccagccgtgagattcccaggagattccacttggtgatcagcactgaacacagacctccaaccatggagtttgggcttagctgcgttttccttgttgctattttaaaaggtgtccaatgtgaggtgcagctggttgagtctgggggaggcttggtacagccagggcggtccctgagactctcctgtgtaacctcaggattcatgtttggtgattatggaatgacctgggtccgccaggctccaggggagggcctggagtgggtagctttcgttagcagaaagactgaaggtgggacaacagaatacgccgcgtctgtgaaaggcagatttatcatctcaagagacgattccaaaggcatcgcctatctgcaaatgaacagcctgaaaaccgaggacacagccgtgtattttgtactagagtcttcttgtattactatgatacta

SEQ ID NO: 786276 - DNA, 466 bp, Homo sapiens
  misc_feature: NA.51.24.C02.1.454.heavy.3.nb
tagggaaagggggctctgggagaggagcccagcactagaagtcggcggtgtttccattcggtgatcagcactgaacacagacgactcaccatggactttgggctgagctgggttttcctcgttgctcttttaagaggtgtccactgtcaggtgcagttggtggagtctgggggaggcgcggtccagcctgggaggtccctgaggctctcctgcgcgtcctctggactccccttcagcacttatgacatgcactgggtccgccaggctccaggcaaggggctggagtgggtggcagtcatatcatatgatggaaaggataagtactatgcagactccatgaagggccgatccaccatctccagggacaattccaagaacacactgtatctgcaaataaacaacctgagagttgcggacacggctgtctattactgtgcggcacgtgggggactacggtgacaacgtc

SEQ ID NO: 786277 - DNA, 479 bp, Homo sapiens
  misc_feature: NA.13.63.F08.1.454.heavy.3.nb
aggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttggggcgcggactcctcttgagatctggggccaggggacaatggtcaccgtctcttca

SEQ ID NO: 786278 - DNA, 465 bp, Homo sapiens
  misc_feature: NA.10.88.H11.1.454.heavy.3.nb
aacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtattccggggggacacatgacaccg

SEQ ID NO: 786279 - DNA, 442 bp, Homo sapiens
  misc_feature: NA.47.59.F04.1.454.heavy.3.nb
tagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgagagcacagcggccctgggctgcctggtcaaggactacttcctacgtgagct

SEQ ID NO: 786280 - DNA, 625 bp, Homo sapiens
  misc_feature: NA.3.71.G05.1.454.heavy.3.nb
agctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatgtacgatttttggaactcttattaccgctttgactactggggccagggaaccctggtcaccgcctcctcagcctccaccaagggcccatcggtcttccccctggcaccctcctccaagagcacctctgggggcacagcggccctgggctgcctggtcaaggactacttccgagtgcgtct

SEQ ID NO: 786281 - DNA, 472 bp, Homo sapiens
  misc_feature: NA.49.73.G07.1.454.heavy.3.nb
agggcacgaccggtgctcgatttaggatagtgtgttgggggggagtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtgacttatatcatatgatggaagtaataaatactatgcagactccgtgaagggccgattcaccatctccagagacaattccaagaacacgctgtatctgcaaatgaacagcctgagacctgaggacacggctgtgtattactgtgcgaactt

SEQ ID NO: 786282 - DNA, 268 bp, Homo sapiens
  misc_feature: NA.14.28.C06.1.454.heavy.3.nb
tgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 786283 - DNA, 203 bp, Homo sapiens
  misc_feature: NA.52.28.C06.1.454.heavy.3.nb
agctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtg

SEQ ID NO: 786284 - DNA, 473 bp, Homo sapiens
  misc_feature: NA.17.25.C03.1.454.heavy.3.nb
accatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccagggacg

SEQ ID NO: 786285 - DNA, 351 bp, Homo sapiens
  misc_feature: NA.11.70.G04.1.454.heavy.3.nb
actggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 786286 - DNA, 481 bp, Homo sapiens
  misc_feature: NA.12.58.F03.1.454.heavy.3.nb
aagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggccggttcaccatctccagagacaacgccaagaattcactgtatctgcaaatgaacagcctgagagtcgaagacacgggtatttattattgtgtgcgagatctggatttccttcgaaatgaagtgtggttcgatgtgtttgat

SEQ ID NO: 786287 - DNA, 622 bp, Homo sapiens
  misc_feature: NA.8.33.C11.1.454.heavy.3.nb
ttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccaagtactcctttgacgtctggggccagggtaccctggtcaccgtctcctcagcctccaccaagggcccatcggtcttcccctggcgccctgctccaggagcacctccgagagcacagcggccctgggctgcctggtcaaggactacttccgacacgcgag

SEQ ID NO: 786288 - DNA, 478 bp, Homo sapiens
  misc_feature: NA.9.43.D10.1.454.heavy.3.nb
agggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggccagggaaccctggtcaccgtctcctcag

SEQ ID NO: 786289 - DNA, 618 bp, Homo sapiens
  misc_feature: NA.51.38.D05.1.454.heavy.3.nb
ttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgtgcgccaggaagcagtggctggccacatcatgcttttgatatctggagccaagggacaatggtcatcgtctcttcggcctccaccaagggcccatcggtcttccccctggcaccctcctccaagagcacctctgggggcacagcggccctgggctgcctggtcaaggactacttcctcgtagcact

SEQ ID NO: 786290 - DNA, 607 bp, Homo sapiens
  misc_feature: NA.22.86.H09.1.454.heavy.3.nb
ttgagctctgggagaggagcccagcactagaagtcggcggtgtttccattcggtgatcagcactgaacacagaggactcaccatgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgccctgctccaggagcacctccgagagcacagcggccctgggctgcctggtcaaggactacttccagacgtatca

SEQ ID NO: 786291 - DNA, 626 bp, Homo sapiens
  misc_feature: NA.13.37.D04.1.454.heavy.3.nb
ttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggcaccctcctccaagagcacctctgggggcacagcggccctgggctgcctggtcaaggactacttccgtactagacg

SEQ ID NO: 786292 - DNA, 638 bp, Homo sapiens
  misc_feature: NA.10.34.D01.1.454.heavy.3.nb
ttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcaggaccgatattgttctgatggcgtatgctctaaggaggaccttgacttctggggccagggaaccctggtcaccgtctcctcagcctccaccaagggcccatcggtcttcccctggcgccctgctccaggagcacctccgagagcacagcggccctgggctgcctggtcaaggactacttcccactactatg

SEQ ID NO: 786293 - DNA, 622 bp, Homo sapiens
  misc_feature: NA.53.10.A10.1.454.heavy.3.nb
aggggtctgagagaggagccttagtcctggaatccaaggcctctccacttggtgatcagcactgagcaccgaggattcaccatggaactggggctccgctgggttttccttgttgctattttagaaggtgtccactgtgaggaacaactggtggagtctgggggaggcctggtcaagcctggggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttggggtttcgacccctggggccagggaaccctggtcaccgtctcctcagcctccaccaagggcccatcggtcttcccctggcaccctcctccaagagcacctctgggggcacagcc

SEQ ID NO: 786294 - DNA, 371 bp, Homo sapiens
  misc_feature: NA.51.41.D08.1.454.heavy.3.nb
ctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 786295 - DNA, 611 bp, Homo sapiens
  misc_feature: NA.51.43.D10.1.454.heavy.3.nb
agggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaatttcgacttctggaataattacttgggttggaaactaccttcattactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 786296 - DNA, 508 bp, Homo sapiens
  misc_feature: NA.21.70.G04.1.454.heavy.3.nb
tctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttcccctggcgccctgctccaggagcacctccgagagcacagcggccctgggctgcctggtcaaggactacttcccgagcgacga

SEQ ID NO: 786297 - DNA, 651 bp, Homo sapiens
  misc_feature: NA.11.67.G01.1.454.heavy.3.nb
ttgggtttggggagctctgagagaggagcccagccctgggattttcaggtgttttcatttggtgatcaggactgaacagagagagctcaccatggagtttgggctgagctggctttttcttgtggctattttaaaaggtgtccagtgtgaggtggagttattgcagtctggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctgggggcacagcggccctgggctgcctggtcaaggactacttccgtatctctcg

SEQ ID NO: 786298 - DNA, 445 bp, Homo sapiens
  misc_feature: NA.51.14.B03.1.454.heavy.3.nb
ttgggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 786299 - DNA, 427 bp, Homo sapiens
  misc_feature: NA.19.36.D03.1.454.heavy.3.nb
acccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattacacctttagcaactacggcatcacctgggtgcgacaggcccctggacaagggcttgagtggatgggatggatcagcgcttacagtcataacacaaactatgcaccgaaactccagggcagagtcaccataaccacagacacatccacgagcacagcctacatggaactgaggagcctgagagctgacgacacggccgtgtattactgtgcgaaatggggagatattgtactgatgc

SEQ ID NO: 786300 - DNA, 482 bp, Homo sapiens
  misc_feature: NA.17.28.C06.1.454.heavy.3.nb
aggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggagccctggtcaccg

SEQ ID NO: 786301 - DNA, 597 bp, Homo sapiens
  misc_feature: NA.4.87.H10.1.454.heavy.3.nb
ttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaggaagcctggggcctcagtgaaggtctcctgcaagacttctggatacaccttcgccggctactatatgcactggattcgacaggcccctggacaagggcttgagtggatggggtggatcaacccttacagtggtgtcacaaactatgcacagaagtttcagggctgggtcaccgtgaccagggacacgtccgtcagcacagtttacatggaactgaggaaactgagatctgacgacacggccgtctactactgtgcgagagggtacacggttataccatctgcgctagacttcgatattttgaaaggccatcattggtacttcgatctctggggccgtggcaccctggtcactgtctcctcagcctccaccaagggcccatcggtcttccccctggcaccctcctccaagagcacctctgggggcacagcgg

SEQ ID NO: 786302 - DNA, 593 bp, Homo sapiens
  misc_feature: NA.14.38.D05.1.454.heavy.3.nb
ttgggtttgggggggaaatactttctgagactcatggacctcctgcacaagaacatgaaacacctgtggttcttcctcctcctggtggcagctcccagatgggtcctgtcccaggtgcagctgcgggagtcgggcccaggactggtgaagccctcggggaccctgtccctcacctgcgctgtctctggtggctccatcagcagtactaactggtggagttgggtccgccagcccccagggaaggggctggagtggattggacaaatctatcgtagtgggagcaccaactacaacccgtccctcaagactcgagtcaccatatcaatagacacatccaagaatcaattctccctgaagctgagctctgtgaccgccgcggacacggccgtctactactgtgcgagaacaatcggtgctacgctttttggagtgaacggctggttcgacccctggggccagggaacccaggtcaccgtctcctcagcctccaccaagggcccatcggtcttccccctggcaccctcctccaagagcacctctgggggcacagcggccctgggctgcctggtcaaggactacttccgtactagacg

SEQ ID NO: 786303 - DNA, 649 bp, Homo sapiens
  misc_feature: NA.40.20.B09.1.454.heavy.3.nb
agggcacgaccggtgctcgatttagtgtagtgtgaagggggagagaggagccttagccctggattccaaggcctatccacttggtgatcagcactgagcaccgaggagtcaccatggaactgggactccgctgggttttccttgttgcgattttagaaggtgtcaagtgtgaggtgcgactggtcgagtctgggggaggcctggtcaagccgggggggtccctgagactctcctgtgcagcctctggactcaccttcaggagtttcagtatgaattgggtccgccaggctccagggaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttccccctggcgccctgctccaggagcacctctgggggcacagcggccctgggctgcctggtcaaggactacttccagtcgctaga

SEQ ID NO: 786304 - DNA, 349 bp, Homo sapiens
  misc_feature: NA.22.29.C07.1.454.heavy.3.nb
agggaaaggggctggagtgggtctcaggtattagtgataatgcttttagcacaaactacgcagactccgtgaagggccggttcaccatctccagagacaattccaagaacacgctgtatttgcaaatgaacagcctgagagccgaagacacggccgtctattactgtgcgagattaccgcatacggtgactacctactttctcgactggggccagggaaccctggtcaccgtctcctcagcctccaccaagggcccatcggtcttccccctggcgccctgctccaggagcacctccgagagcacagcggccctgggctgcctggtcaaggactacttccagacgtatgt

SEQ ID NO: 786305 - DNA, 345 bp, Homo sapiens
  misc_feature: NA.16.59.F04.1.454.heavy.3.nb
tagggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccacggtcaccgtctcctcacctccaccaagggcccatcggtcttccccctggcaccctcctccaagagcacctctgggggcacagcggccctgggctgcctggtcaaggactacttccgagtagtaca

SEQ ID NO: 786306 - DNA, 574 bp, Homo sapiens
  misc_feature: NA.7.78.H01.1.454.heavy.3.nb
acccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 786307 - DNA, 625 bp, Homo sapiens
  misc_feature: NA.14.57.F02.1.454.heavy.3.nb
ttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggcaccctcctccaagagcacctctgggggcacagcggccctgggctgcctggtcaaggactacttccgtactagacg

SEQ ID NO: 786308 - DNA, 476 bp, Homo sapiens
  misc_feature: NA.2.85.H08.1.454.heavy.3.nb
tcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaagggcttgagtggctgggggggatcatccctatgtttggtgaagcaaattacgcacagaagttccggggaagagtctcgattaccgcggacgaatccacgaacacagcctacatggaagtgaccagcctgagatctgaagacacggccgtgtattactgtgcgaagtcgtattactatgatactggtgattatttgaatttcgactcctaccactacggtatggacgtctggggccaggggaccacggtcaccgtctctt

SEQ ID NO: 786309 - DNA, 487 bp, Homo sapiens
  misc_feature: NA.21.86.H09.1.454.heavy.3.nb
ttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgacccctggggccagggaaccctagtcaccgtctcctcagcctccaccaagggcccatcggtcttcccctggcgccctgctccaggagcacctccgagagcacagcggccctgggctgcctggtcaa

SEQ ID NO: 786310 - DNA, 627 bp, Homo sapiens
  misc_feature: NA.16.80.H03.1.454.heavy.3.nb
aagggaaagggggctgtgggagaggagccccaggcccgggattcccaggtgtttccattcagtgatcagcactgaagacaggagactcatcatggagttctggctgagctgggttctccttgttgccattttaaaagatgtccagtgtgaggtgcagctggtggagtctgggggaggcttggtccagccgggggggtccctgagactctcctgttcagcctctggattcatcttcagcggtttcgctatgcactgggtccgccaggctccaggaaagggactggaatatgtttcagctattagttataatgggggtaacacatactacgcagactcagtgaagggcagattcaccatctccagagacaattcccagaacacgctggatcttcaaatgagcagtctgagagctgaggacacggctgtgtattactgtgtgaaagatttccgtggctactacgactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 786311 - DNA, 614 bp, Homo sapiens
  misc_feature: NA.11.27.C05.1.454.heavy.3.nb
agggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgatgcttttgatttctggggccaagggacaatgctcaccgtctcttcagcctccaccaagggcccatcggtcttccccctggcaccctcctccaagagcacctctgggggcacagcggccctgggctgcctggtcaaggactacttccgtatctctcg

SEQ ID NO: 786312 - DNA, 613 bp, Homo sapiens
  misc_feature: NA.49.39.D06.1.454.heavy.3.nb
cagttctttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcctgtgcagcctctggatttaccttcagcagctatgctatgcactggttccgccaggctccaggcaaggggctggagtgggtggcagttatttcatatgatggaagcgataaatactacgcagactccgtgaagggccgagtcaccatctccagacacaattccaagaacacggtgtttctgctggtgaacagcctgagaactgaggacacggctgtgtattactgtgcggcaggcaacgattactacccgaaggactactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 786313 - DNA, 444 bp, Homo sapiens
  misc_feature: NA.13.15.B04.1.454.heavy.3.nb
tccgcgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagagtacacattaaattacta

SEQ ID NO: 786314 - DNA, 430 bp, Homo sapiens
  misc_feature: NA.49.15.B04.1.454.heavy.3.nb
tccgcgggcacgaccggtgctcgatttagacagtatatatccgcgggcacgaccggtgctcgatttagacacatacgcagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 786315 - DNA, 635 bp, Homo sapiens
  misc_feature: NA.9.34.D01.1.454.heavy.3.nb
ttgggtttggggtctgagagaggagcccagccctgggattgtcaggtgttttcatttggtgatcaggactggacagagagaactcaccatggagtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 786316 - DNA, 429 bp, Homo sapiens
  misc_feature: NA.11.79.H02.1.454.heavy.3.nb
agggaaagggtccctgagactctcctgtgcagcctctggattcacttttagcaactatgtcatgcactgggtccgccaggctcctggaaaggggctggagtgggtctcgtctattgctggcaatgataataccgtaaactacgcagactccgtgaagggccggttcaccatctccagggacaattccatgaacacactttatcttcaattgaacaccctgagggccgacgacacggccgtatattactgtgcgaaggactacgatctcgagtacttctttgaccactggggccagggaaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 786317 - DNA, 597 bp, Homo sapiens
  misc_feature: NA.14.26.C04.1.454.heavy.3.nb
tctcagagaggagccttagccctggactccaaggcctttccacttggtgatcagcactgagcacagaggactcaccatggagttggggctgagctgggttttccttgttgctattttagaaggtgtccagtgtgaggtgcagttggtggactctgggggaggcttggtccagcctggggggtccctgagactctcctgtgcagcctctggattcacctttagtaaatattggatgatgtgggtccgccaggctccagggaaggggctggagtgggtggcccacataaacgaagacggaattaagaaatactatctggactctgtgaagggccgattcaccatctccagagacaacgccgagaactcactgtatctgcagatgaacagcctgagagccgaagacacggccgtgtattactgtacgagagacgttgggtttaaaacttttgactattggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 786318 - DNA, 450 bp, Homo sapiens
  misc_feature: NA.49.17.B06.1.454.heavy.3.nb
aggggtctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgaggggccgattcaccatctccagagacagttccgatgacacagtgtatctgcaaatgaacagcctgagacctgaggacacggctctcttttactgtgcgccaggaagcagtggctggccg

SEQ ID NO: 786319 - DNA, 576 bp, Homo sapiens
  misc_feature: NA.5.23.C01.1.454.heavy.3.nb
tagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctggagtggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgat

SEQ ID NO: 786320 - DNA, 412 bp, Homo sapiens
  misc_feature: NA.2.28.C06.1.454.heavy.3.nb
tccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccgggagccctggtcaccgtctcctcagcctccaccaagggcccatcggtcttccccctggcgccctgctccaggagcacctccgagagcacagcggccctgggctgcctggtcaaggactacttcctgtcgagcgt

SEQ ID NO: 786321 - DNA, 479 bp, Homo sapiens
  misc_feature: NA.47.64.F09.1.454.heavy.3.nb
agggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgatatttggggccaagggacaagggtcaccgtctccgcagcctccaccg

SEQ ID NO: 786322 - DNA, 704 bp, Homo sapiens
  misc_feature: NA.14.60.F05.1.454.heavy.3.nb
gggaaaggggaagactgacggtcctcccaggagttcaggtgctgggcaccgtgggcatgggggaggtgtgtcacaagatttgggctctgggagaggagctccagccctgggattcccagctgtctccactcggtgatcggcactgattacaggagactcaccatggagtttgggctgagctgggttttccttgttgctattttaaaaggtgtccagtgtgaggtgcagctggtggagtctgggggaggcttggtccagcctggggggtccctgaaactctcctgtgcagcctctgggttcaccttcagtgactctgctatgcactgggtccgccaggcttccgggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatattttgactggtcggcgggggttcgacccctggggccagggaaccctggtcaccgtctcctcagcttccaccaagggcccatcggtcttccccctggcgccctgctccaggagcacctctgggggcacagcggccctgggctgcctggtcaaggactacttccgtactagacg

SEQ ID NO: 786323 - DNA, 404 bp, Homo sapiens
  misc_feature: NA.3.86.H09.1.454.heavy.3.nb
ttgggtttgggattcacgttgcagatgtaggtctgggtgcgacaggctcctggaaaagggcttgagtggatgggaggttttgatcctgaagagcgtgaaagaatctacgcacagaatttccagggcagagtcaacatgaccgaggacacatccacagacacatcctacatggagttgaccagcctgagatctgaagacacggccgtgtattattgtgcaacagtcgcggctagcgcagcgggccctgatgcttttgatatctggggcccagggacattggtcaccgtctcttcagcctccaccaagggcccatcggtcttccccctggcaccctcctccaagagcacctctgggggcacagcggccctgggctgcctggtcaaggactacttccgagtgcgtct

SEQ ID NO: 786324 - DNA, 525 bp, Homo sapiens
  misc_feature: NA.17.33.C11.1.454.heavy.3.nb
tcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggcccatcggtcttcccctggcaccctcctccaagagcacctctgggggcacagcggccctgggctgcctggt

SEQ ID NO: 786325 - DNA, 442 bp, Homo sapiens
  misc_feature: NA.17.27.C05.1.454.heavy.3.nb
agggtttggggacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgagggtctcctgcaaggcttctgcaggcacctttagcaactatgctttcagctgggtgcgacaggcccctggacaagggcttgagtggatgggagggatcattcctatccttgggacagtaaggtatccacagaagttccagggcaaagtcaccattaccgcggacgaatccacgagcacagcctacattgagttgagcagcctcagatctgaggacacggccgtgtattactgtgcgagagggtccggagacacaatggcagtag

SEQ ID NO: 786326 - DNA, 620 bp, Homo sapiens
  misc_feature: NA.12.85.H08.1.454.heavy.3.nb
tcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggatcggggagtttggttcctggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 786327 - DNA, 591 bp, Homo sapiens
  misc_feature: NA.2.16.B05.1.454.heavy.3.nb
ttgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccgggagccctggtcaccgtctcctcagcctccaccaagggcccatcggtcttccccctggcgccctgctccaggagcacctccgagagcacagcggccctgggctgcctggtcaaggactacttcctgtcgagcgt

SEQ ID NO: 786328 - DNA, 602 bp, Homo sapiens
  misc_feature: NA.13.4.A04.1.454.heavy.3.nb
aggggtctgagagaggagcccagccctgggattttcaggtgttttcatttggtgatcaggactgaacagagagaactcaccatggaatttgggctgagctggctttttcttgtggctattttaaaaggtgtccagtgtgaagtgcagctggtggagtctgggggaggcttggtacagcctgggaggtccctgagactctcctgtgcagcctctggattcacctttagcaactatgccatgagctgggtccgccaggctccagggaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 786329 - DNA, 643 bp, Homo sapiens
  misc_feature: NA.9.37.D04.1.454.heavy.3.nb
ttgggtttgggggctctgagagaggagcccagccctgggattttcaggtgttttcatttggtgatcaggactgaacagagagaactcaccatggagtctgggctgagctggcttcttcttgtggctattttaaaaggtgtccagtgtgaggtgcatctattggagtctgggggagccctggtacagccgggggggtccctgacactctcctgtacagcctctggattcacctttaacacctatgcattgagctgggtccgccaggccccagggaaggggctggactgggtcgcagccattagtggcaatggcgaaaacacatattacgcagactccgtgaagggccggttcaccatttccagagacaatttcaagaacacgctgtatctgcagatgaacagcctgagagccgaggacacggccgtatatcactgtgccaaagatcagaaggacggttcggggagttacaaatattactacttctactatggaatggacgtctggggccgagggaccacggtcaccgtctcctcagcctccaccaagggcccatcggtcttcccctggcaccctcctccaagagcacctctgggggcacagcggccctgggctgcctggtcaaggactacttccagacgtatca

SEQ ID NO: 786330 - DNA, 622 bp, Homo sapiens
  misc_feature: NA.51.71.G05.1.454.heavy.3.nb
agctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggactacttcctcgtagcact

SEQ ID NO: 786331 - DNA, 585 bp, Homo sapiens
  misc_feature: NA.15.28.C06.1.454.heavy.3.nb
aggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttccccctggcgccctgctccaggagcacctccgagagcacagcggccctgggctgcctggtcaaggactacttccgctacgtaga

SEQ ID NO: 786332 - DNA, 614 bp, Homo sapiens
  misc_feature: NA.53.42.D09.1.454.heavy.3.nb
agggaaagggggagccccagccctgggattcccagctgtttctgcttgctggtcaggactgcacacagagaactcaccatggagtttgggctgtactgggttttccttgtcgcaattttaaaaggtgtcctgtgtgaggaaaagctggtggagtccgggggaggcttagttcagccgggggggtccctgagactctcctgtgcagcctctggattcaccttcagaaattattggatgcactgggtccgccatgttccggggaaggggctgttgtgggtctcacgtattaatggagatgggagcagcacacacaacgcggactccgtgaagggccgattcatcatctccagagacaacgtcaagaatatactatatctgcagatgaatggtctgagggccgacgactcggctgtgttctactgtgcaagaggcggcagtggctacagtgcctactactacggtctggacgtctggggccaggggaccactgtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 786333 - DNA, 479 bp, Homo sapiens
  misc_feature: NA.48.43.D10.1.454.heavy.3.nb
aggggacatgggaagtgctttctgagagtcatggacctcctgcacaagaacatgaaacacctgtggttcttcctcctcctggtggcagctcccagatgggtcctgtcccaggtacagctacaacagtggggcgcaggacatttgaagccttcggagacgctgtccctcacctgcgctgtgtatggtgggtccttcaggggttacttctggacctggatccgccagcccccagggaaggggctggagtggattggggaggtcaggcatagtgccagggccacttacaacccgtccctcaacgatcgagtctccatcttagttgacacgtccaagaaccagttctcccttcaactcacgtctgtgaccgccgcggacacggctatatactactgtgcgagagggtccctggctctctccgcctttgacgcctggggccagggaaaactggtcaccgtctcctcagcttccaccaagggccc

SEQ ID NO: 786334 - DNA, 372 bp, Homo sapiens
  misc_feature: NA.51.60.F05.1.454.heavy.3.nb
gggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 786335 - DNA, 471 bp, Homo sapiens
  misc_feature: NA.2.4.A04.1.454.heavy.3.nb
agggggctttctgagagtcatggatctcatgtgcaagaaaatgaagcacctgtggttcttcctcctgctggtggcggctcccagatgggtcctgtcccagctgcagttgcaggagtcgggcccaggactggtgaagccttcggagaccctgtccctcacctgcactgtctctggtgcctccatcagcagtagtagttattactggggctggattcgccagcccccagggaaggggctggagtggattgggagtttctattatggtgggggaacctactacaacccgtccctcaagagtcgagtcaccgtatccttagacacgtccaagaaccaattctccctgaaactgaactctatgaccgccgcagacacggctgtttattattgtacgggccgtgtaacgttggactactggggccagggagccgtggtcaccgtctcctcagcctccaccaagggcccatcggtctt

SEQ ID NO: 786336 - DNA, 646 bp, Homo sapiens
  misc_feature: NA.52.57.F02.1.454.heavy.3.nb
ttgggtttggggtctgagagaggaggccagccctgggattttcaggtgttttcatttggtgatcaggactgaacagagagaactcaccatgggtttgggctgagctggctctttcttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagtggccaaagacggcaggttccgctacgggttggacgtctggggccaagggaccacggtcaccgtcgcctcagcctccaccaagggcccatcggtcttcccctggcaccctcctccaagagcacctctgggggcacagcggccctgggctgcctggtcaaggactacttcctatacgatcg

SEQ ID NO: 786337 - DNA, 439 bp, Homo sapiens
  misc_feature: NA.49.60.F05.1.454.heavy.3.nb
gggaaaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgt

SEQ ID NO: 786338 - DNA, 495 bp, Homo sapiens
  misc_feature: NA.16.39.D06.1.454.heavy.3.nb
cagttctttgggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggccctggggccagggaaccgtggtcaccgtctcctcagcctccaccg

SEQ ID NO: 786339 - DNA, 587 bp, Homo sapiens
  misc_feature: NA.4.28.C06.1.454.heavy.3.nb
ccccagccctgggattcccagctgtttctgcttgctgatcaggactgcacacagagaactcaccatggaatttgggctgagctgggttttccttgttgctattttaaaaggtgtccagtgtgaggtgctcctggtggagtccgggggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaagggcccatcggtcttcccctggcgccctgctccaggagcacctccgagagcacagcggccctgggctgcctggtcaaggactacttccctacagtgct

SEQ ID NO: 786340 - DNA, 542 bp, Homo sapiens
  misc_feature: NA.4.33.C11.1.454.heavy.3.nb
ttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggagttttacgatttttggagtggatattataacccccactttgactactggggccagggaaccctggtcgccgtctcctcagcctccaccaagggccca

SEQ ID NO: 786341 - DNA, 628 bp, Homo sapiens
  misc_feature: NA.53.8.A08.1.454.heavy.3.nb
aggggctgggagaggagcccagcactagaagtcggcggtgtttccattcggtgatcagcactgaacacagaggactcaccatggagtttgggctgagctgggttttcctcgttgctcttttaagaggtgtccattgtcaggtgcagttggtggagtcggggggatctgtggtccggcctgggaggtccctgagactctcctgtacagcctccggattcagcttcgagaactatggcttgcactgggtccgccaggctccaggcaaggggctggagtgggtggcagttatttcatatgattcaagtattggatattacgcagactctgttaagggccgattcaccatctccagagacaattccaagaacaccctgtatctgcaattgagcagactcacagctgaggacacggctgtgtattactgtgtgaaagacgtttatgagagtagtggtttttccgagtacgcacattacggtatggacgtctggggccaagggaccccggtcaccgtctccttagcctccaccaagggcccatcggtcttccccctggcaccctcctccaagagcacctctgggggcacagcggccctgggctgcctggtcaaggactacttcctcgtactgcg

SEQ ID NO: 786342 - DNA, 487 bp, Homo sapiens
  misc_feature: NA.13.38.D05.1.454.heavy.3.nb
ttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggccgcgacgagttcgactacgtc

SEQ ID NO: 786343 - DNA, 420 bp, Homo sapiens
  misc_feature: NA.53.72.G06.1.454.heavy.3.nb
ctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattact

SEQ ID NO: 786344 - DNA, 607 bp, Homo sapiens
  misc_feature: NA.3.67.G01.1.454.heavy.3.nb
ttgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 786345 - DNA, 452 bp, Homo sapiens
  misc_feature: NA.19.59.F04.1.454.heavy.3.nb
tagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtgcagcctctggattcaccttcagtagttatgaaatgaattgggtccgccaggctccagggaaggggctggagtgggtttcatacattagtagtagtggtagtagcatatactacgcagactctgtgaagggccgattcaccatctccagagacagcgccaagaactcactgtatctgcaaatgaacagcctgagagccgaggacacggcagtttattactgtgcgagagagtggct

SEQ ID NO: 786346 - DNA, 628 bp, Homo sapiens
  misc_feature: NA.53.77.G11.1.454.heavy.3.nb
aagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcggctggtggagtctggggggggctggtccagcctgggaggtccctgagactctcctgtgcagcgtctggattcagtctcagcatctatggcgtgcattgggtccgccaggctccaggcaaggggcttgagtgggtggcagttatgtactatgatggaagtaataaatattatgcagacttcgtgaagggccgattcaccatctccagagacagttccaaggacatcctgtatctccaaatgaacagcctgagacccgaggacacggctgtctactactgtgcgagggggggactagatttggtggctacgatcacccccatttttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 786347 - DNA, 457 bp, Homo sapiens
  misc_feature: NA.21.23.C01.1.454.heavy.3.nb
tagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaaggccccagaactggaactacgccatggacgt

SEQ ID NO: 786348 - DNA, 617 bp, Homo sapiens
  misc_feature: NA.40.37.D04.1.454.heavy.3.nb
ttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 786349 - DNA, 420 bp, Homo sapiens
  misc_feature: NA.11.21.B10.1.454.heavy.3.nb
ctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattact

SEQ ID NO: 786350 - DNA, 624 bp, Homo sapiens
  misc_feature: NA.49.25.C03.1.454.heavy.3.nb
agctctgagagaggagcccagccctgggattttcaggtgttttcatttggtgatcaggactgaacagagagaactcaccatggagtttgggctgagctggctttttcttgtggctactttaaaaggtgtccagtgtgacgtccaactggtggagtctgggggaggcttggtgcagcctggggggtccctgagactctcctgtgtagcctctgagttcacctttagagtctatgccatgagttgggtccgccaggctccagggaaggggctggagtgggtctcaggtatcagtggtaatgatggtaacacaaactatgcagactccgtgaagggccggttcaccatctccagagacaattccaagaatatgctatttctgcaaatgaacagcctgagaatcgaggacacggccgtatattactgtgtgaaagaagatggaccgctggacgaggagccctacggcgggtcctactttgactactggggccggggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 786351 - DNA, 607 bp, Homo sapiens
  misc_feature: NA.3.39.D06.1.454.heavy.3.nb
cagttctttgggttttggggagaggagcccagcactgggattccgaggtgtttccattcggtgatcagcactgaacacagaggactcaccatggagttttggctgagctgggttttccttgttgctttttcaaaaggtgtccagtgtgaggtgcagatggtggagactggaggaggcttgatccagccgggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 786352 - DNA, 475 bp, Homo sapiens
  misc_feature: NA.12.71.G05.1.454.heavy.3.nb
aagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccaggagcacctccgagagcacagcggccctgggctgcctggtcaaggactacttcctacgtcgtat

SEQ ID NO: 786353 - DNA, 393 bp, Homo sapiens
  misc_feature: NA.14.74.G08.1.454.heavy.3.nb
agggatccggcagctcccagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacg

SEQ ID NO: 786354 - DNA, 461 bp, Homo sapiens
  misc_feature: NA.13.9.A09.1.454.heavy.3.nb
agggggggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggacacagccatctattactgtgctagagagtattgcagtcctacgacctgct

SEQ ID NO: 786355 - DNA, 289 bp, Homo sapiens
  misc_feature: NA.53.44.D11.1.454.heavy.3.nb
agggccggttcatcatgtccagagacaactccaagaacacactgtatctgcaaatgaacagcctaagagccgaggacacggccgtatattactgtgcgaagatttgggggtggcaactggagtggtttttagatccgattgactcctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 786356 - DNA, 626 bp, Homo sapiens
  misc_feature: NA.4.26.C04.1.454.heavy.3.nb
agctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtctgggggaggcttggtacagcctggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtgcaactggctcgacccctggggccagggaacccatgtcaccgtctcctcagcctccaccaagggcccatcggtcttcccctggcgccctgctccaggagcacctccgagaacacagcggccctgggctgcctggtcaaggactacttccctacagtgct

SEQ ID NO: 786357 - DNA, 503 bp, Homo sapiens
  misc_feature: NA.11.13.B02.1.454.heavy.3.nb
ttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 786358 - DNA, 454 bp, Homo sapiens
  misc_feature: NA.12.2.A02.1.454.heavy.3.nb
aggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgatacttattgtagtggtggtacctgctacttttt

SEQ ID NO: 786359 - DNA, 449 bp, Homo sapiens
  misc_feature: NA.47.48.E04.2.454.heavy.3.zerom50
  modified_base (424)..(424): a, c, t, g, unknown or other
ctcagagaggagccttagccctggactccaaggcctttccacttggtgatcagcactgagcacagaggactcaccatggaattggggctgagcgtgggttttccttgttgctattttagaaggtgtccagtgtgaggtgcaattggtgcaatctgggggaggcttggtccagcctggggggtccctcagactctcctgtgcagcctctggmttcaccttyartwmytmtkskatgmaktgggtccgccagrctccaggsaaggggctrgagtgggttggcgrwcatatmrtccagatggamrtcwkmarwmytaygyrgactcyctgargggccgattcaccatctccagagacaattcccagaacacggtctatctgcacctgaccagcctgagaactgacgacacgtctctctactactgtncgagagagttgacgwgtcatttgtg

SEQ ID NO: 786360 - DNA, 270 bp, Homo sapiens
  misc_feature: NA.4.20.B09.2.454.heavy.3.zerom50
agggccggttcaccatctccagagacaacagcaaagactccctgtatctgcaaatgaacagtctgagaactgaggacaccgccttatattactgtgcaagaggcggtgtgggaggtagtcttgactcctgggaccagggaaccctggtcaccgtctcctcagcctccaccaagggcccatcggtcttccccctggcaccctcctccaagagcacctctggggcacagcggccctgggctgcctggtcaaggactacttccctacagtgct

SEQ ID NO: 786361 - DNA, 454 bp, Homo sapiens
  misc_feature: NA.53.15.B04.1.454.heavy.3.zerom50
tccgcgggggctctgggagaggagcccagcactagaagtcggcggtgtttccattcggtgatcagcactgaacacagaggactcagcatggagtttgggctgagctgggttttcctcgttgctcttttaagaggtgtccagtgtcaggtgcaactggtggagtctgggggaggcgtggtccagcctgggaagtcactgcgactctcctgtgcagcctctggattcagcttcagctcgtatgcgatgcactgggtccgccaggctccaggcaaggggctggagtgggtggcggttatttcacatgatggaagtcaggaatattatgcagactccgtgaggggccgattcaccatctcccgagacaattccaagaacacagtggatctgcaaatgagtagcatgagaggttggggacacgggcggtgtattactgtgcgaaggcttggcttcgtty

SEQ ID NO: 786362 - DNA, 359 bp, Homo sapiens
  misc_feature: NA.17.79.H02.1.454.heavy.3.zerom50
agggaaaggggctggagtgggtctcaactattagtggtcgcggtactactacatattacgcagactccgtgaagggccggttcaccatctccagagacaattccaacaacacactgtttctgcaaatgaacagcctgagagccgaggacacggccgtctattactgtgcgaaagaggggaggcacattgtggtggtggctagtgttattgactactggggtcagggatccctggtcaccgtctcctcagcttccaccaagggcccatccgtcttccccctggcgccctgctccaggagcacctcccgagagcacagccgccctgggctgcctggtcaaggactacttccctagtctacg

SEQ ID NO: 786363 - DNA, 350 bp, Homo sapiens
  misc_feature: NA.3.72.G06.1.454.heavy.3.zerom50
ctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctgtggggcatagtgggtactacctatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccgagtgcgtct

SEQ ID NO: 786364 - DNA, 279 bp, Homo sapiens
  misc_feature: NA.13.66.F11.1.454.heavy.3.zerom50
agggcagattcaccatctccagagatgattcaaggaacacagtgtttctgcaaatgaacagcctgactgccggggacactgccgtgtattactgtgccagcagcagtacctggccactatatttttttgacttctggggccagggaaccctggccaccgtctcctcagcttccaccaagggcccatcggtcttccccctggcgccctgctccaggagcacctctgggggcacagcggccctgggctgcctggtcaaggactacttcctagtacgtgacg

SEQ ID NO: 786365 - DNA, 454 bp, Homo sapiens
  misc_feature: NA.53.45.E01.1.454.heavy.3.zerom50
ctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgtaaacggtttgagtgggaagtaggggtcg

SEQ ID NO: 786366 - DNA, 350 bp, Homo sapiens
  misc_feature: NA.13.30.C08.3.454.heavy.3.zerom50
aagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttcctagtacgtga

SEQ ID NO: 786367 - DNA, 447 bp, Homo sapiens
  misc_feature: NA.49.44.D11.2.454.heavy.3.zerom50
agggtttggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtggggtggcagttatatcatatgatggaagcaagatatactatgtagactccgtgaagggccgattcatcatctccagagacaactccgagaacacgctgtatctgcaaatgaacaggctgagagctgaagacacggctgtagtattactgtgacgtaactt

SEQ ID NO: 786368 - DNA, 332 bp, Homo sapiens
  misc_feature: NA.11.61.F06.1.454.heavy.3.zerom50
ctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggactacttccgtatctctcg

SEQ ID NO: 786369 - DNA, 450 bp, Homo sapiens
  misc_feature: NA.53.41.D08.7.454.heavy.3.zerom50
tgatcatcactgaacacagaggactcaccatggagtttgggctgagctgggttttcctcgttgctcttttaagaggcgtccagtgtcaggtgcagctggtggagtctgggggggggcgtggtccaggctgggaggtccctgagactctcctgtgcagcctctggattcaccttcagtacccatgaaatgcactgggtccgccaggctccaggcaaggggctggagtgggtggcacttatatcctattgatggaagcaataagcactacgcagagtccgtgaagggccgattgaccatctccagagacaactcgaagaatacggttcttctacaaatgaacagcctgagagctgaggacacggctatcttttactgttgcgagagggaactcggattacagcagccctsraagaacatcatgatggctttgatatctggggccaagggact

SEQ ID NO: 786370 - DNA, 458 bp, Homo sapiens
  misc_feature: NA.40.61.F06.2.454.heavy.3.zerom50
agaggagccccagccctgagattcccatgtgtttccattcagtgatcagcactgcacacagaggactcgccatggagtttgggctgagctgggttttccttgttgctattttaaaaggtgtccagtgtgaagtgcacctggtggagtctgggggaggtgtggtgcggccgggggggtctctgagactctcctgtgcagcctctggattcacgtttggtgattatggcatgagctgggtccgccaagctccagggagggggttggaatgggtctctgctattaattggaatggcggtagtggacattatgcagactctgtgaggggccgtttcaccatctccagagacaacgccaagaactccctgtatctgcaaatgaacagtctgaaagtcgaggacacggccttctattactgtgtgagagatgggatggtggcacctgtccctccacactaaacg

SEQ ID NO: 786371 - DNA, 468 bp, Homo sapiens
  misc_feature: NA.21.4.A04.1.454.heavy.3.zerom50
aggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccagggaaggggctggagtgggtcggccgtattacaaggaaagctaacagttacagtacagaatacggcgcgtctgtgaaaggaaggttcaccatctcaagagatgattcaaagaactcactgtatctgcaaatgaacagcctagaaaaccgaggacacggccgtgtattattgtggtagacaaaagagtggatgtggtggtagct

SEQ ID NO: 786372 - DNA, 461 bp, Homo sapiens
  misc_feature: NA.48.16.B05.2.454.heavy.3.zerom50
agggggggagacgagcccagcactggaggtcgccggtgtttccattcggtgatcagcactgaacacagaggactcactatggagtttgggctgacctgggttttcctcgttgctcttttaagaggtgtccagtgtcaggtgcagctggtggagtctggggggcgcgtggtccagcctgggaagtccctgagactctcctgtgcagcctctagattcaccttaagggcccatgctatgcactgggtccgccaggctccaggcaagggactgcagtgggtaacaactatctcatatgacggatctaaaatatacaattcagactccgtgaagggccgattcaccgtctccagagacaattccaagaatatgttgtatctggaaatgagaggcctcagacctgaagacacggctatttatttctgtgtgagaggcctgggctccttgaactgggagccactgga

SEQ ID NO: 786373 - DNA, 441 bp, Homo sapiens
  misc_feature: NA.53.28.C06.3.454.heavy.3.zerom50
agcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacaggggccatccagaacagcctacatggagctgaacagactgacatctgacgacacggccgtttattattgtgtgagagaggaccccgatgacccg

SEQ ID NO: 786374 - DNA, 341 bp, Homo sapiens
  misc_feature: NA.49.70.G04.3.454.heavy.3.zerom50
cttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 786375 - DNA, 276 bp, Homo sapiens
  misc_feature: NA.13.17.B06.1.454.heavy.3.zerom50
agggccgattcaccatctccagagacaacgccaagaactcactgtatctgcagatgaccagcctgagagtcgaggatacggctgtgtattattgtgcgagagatggggcacgacattttgtagaggtgtactggggccagggagccccggtcaccgtctcctcagcctccaccaagggcccatcggtcttccccctggcgccctgctccaggagcacctccgagagcacagcggccctgggctgcctggtcaaggactacttcctagtacgtgacg

SEQ ID NO: 786376 - DNA, 437 bp, Homo sapiens
  misc_feature: NA.49.32.C10.1.454.heavy.3.zerom50
ctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatgtcatatgatggaagtaatatatactatatagactccgtgaagggccgattcatcatctccagagacaattccgagaacacgctgtatctgcaaatgaacagcctgagagttgaggacacggctgtgtattattgtgcgaacttaatcacgga

SEQ ID NO: 786377 - DNA, 442 bp, Homo sapiens
  misc_feature: NA.52.50.E06.2.454.heavy.3.zerom50
tctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatcttttactgtgcgagagggaactcgattac

SEQ ID NO: 786378 - DNA, 252 bp, Homo sapiens
  misc_feature: NA.40.25.C03.1.454.heavy.3.zerom50
ctttctgcaaatgaacagtctgcgagccgacgacacggccatatattattgtgcgggagatcgtccttattatggttcggggaccatggtgcccttattttgacttctggggcctagggaaccccggtcaccgtctccgcagcctccaccaagggcccatcggtcgttccccctggcgccctgctccaggagcacctccgagagcacagcggccctgggctgcctggtcaaggactacttccagtcgctaga

SEQ ID NO: 786379 - DNA, 356 bp, Homo sapiens
  misc_feature: NA.21.60.F05.1.454.heavy.3.zerom50
gggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatcggtcttccccctggcgccctgctccaggagcacctccgagagcacagcggccctgggctgcctggtcaaggactacttcccgagcgacga

SEQ ID NO: 786380 - DNA, 375 bp, Homo sapiens
  misc_feature: NA.51.61.F06.3.454.heavy.3.zerom50
aaggggaaagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcatcgtctcctcagcctccaccaagggcccatcggtcttccccctggcaccctcctccaagagcacctctgggggcacagcggccctgggctgcctggtcaaggactacttcctcgtagcact

SEQ ID NO: 786381 - DNA, 342 bp, Homo sapiens
  misc_feature: NA.3.29.C07.1.454.heavy.3.zerom50
agggaagggcctggagtgggtctcaggtattggattggacaatgataggacaggctatgcggactctgtgaagggccgattcaccgtctccgtggacaaggccaggaggtccatgtttctgcaaatgaacagtctgagagctgacgacacggccctctatttttgtggaaaagacatgacaccggggggtcttgactattggggccagggaatccgggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 786382 - DNA, 295 bp, Homo sapiens
  misc_feature: NA.19.74.G08.1.454.heavy.3.zerom50
agggtcaggaaaaactggttcttcgactcgtcatatcaatggacaagtcgaagaaccagtttttcctgaccctgacctctttgagcgccgcggacacggccgtctattactgtgcgagagcgtggggaagcagtggccctgacaatgacttctggggccagggaatcctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 786383 - DNA, 471 bp, Homo sapiens
  misc_feature: NA.16.85.H08.1.454.heavy.3.zerom50
tcgcggggagctctgagagaggagcccagccctgggattttcaggtgttttcatttggtgatcaggactgaacagagagaacccaccatggagtttgggctgagctggctttttcttgtggccattttaaaaggtgtccaatgtgaggtgcggctattggacgctgggggagaattggtacagcctggggggtccctgagactctcctgtgcagcctctggattcaccttcggcagttatgccatgacgtgggtccgccaggctccagggaagggctgaagtggatctcaggtattagtgttagtggtggtagcacatactacgcagactccgtgaagggtccggttcaccatctccagagacaattccaagaacatgctatatctgcatatgcagaacctgagagacgaagacsacggccatctattactgtgcgagacgcccctccggccatcgctcgtaatsggtacg

SEQ ID NO: 786384 - DNA, 484 bp, Homo sapiens
  misc_feature: NA.13.28.C06.2.454.heavy.3.zerom50
aggtctcagagaggagccttagccctggactccaaggcctttccacttggtgatcagcactgagcacagaggactcaccatggaattggggctgaactgggtttttccttgttgctattttagaaggtgtccagtgtgaagtgcasctggtggagtcyggrggagrcttgrtccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgacggggccgattcaccatctccagagacaattccaagaacacgctgtttcttcaaatgaacagcctgagagccgatgacacgggccgtggtattactggtgcgagagagtggggcccacgaaccgttactacgctagtggtacgtcgtcggggcgaac

SEQ ID NO: 786385 - DNA, 476 bp, Homo sapiens
  misc_feature: NA.17.43.D10.1.454.heavy.3.zerom50
aggggacataacaaccacattcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggattctggaggcaacttcaggaactactttattagttgggtacgtcaggcccctggacaggggcttgagtggatgggagggatcatccctgtctctggtacggcaaattacgcacagaagttccagggcagagtcacgattaccgcggacgaatctacgaacacagcctacatggatctgaacatcctgagatctgacgacacggccgtttattactgtgcgagagcaactagtgcaccttactactttgtctactggggccagggaaccctggtcaccgtctcctcacg

SEQ ID NO: 786386 - DNA, 489 bp, Homo sapiens
  misc_feature: NA.49.13.B02.1.454.heavy.3.zerom50
tcgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggatctcagaggtgaggacaccgccttctactactgtgcaaaagattacggtgaccacacctattttgaccactgcggccagggaaccctagtcaccgtctcctcagcctccaccaagggcccatcggtcttcccctggccccctcctccaagagcacctctgggggcacagcggccctgggctgcctggtcaaggactacttcctcc

SEQ ID NO: 786387 - DNA, 493 bp, Homo sapiens
  misc_feature: NA.2.55.E11.1.454.heavy.3.zerom50
ttgggtttggggctgggagaggagccccagccttgggattcccaagtgttttcattccgtgatcaggactgaacacagaagactcaccatggagtttgggctgagctggattttccttgctgctattttaaaaggtgtccagtgtgaggtgcagctggtggcgtctgggggaggcttcgtaaatcctggggggtcccttggactctcctgtgcaggccctgaattcactctcaataatgcctacataaactgggtccgccaggctccagggaaggggctggagtgggttggccatattaaaagcaaatctgatggtgggacaatacactacgctgcacccgtgaaaggcagattcaccatctcaagagacacttcaagaaattcattgtatctgcaaatgaacagtttagaaaaccgaggaacacagccgtgtattattgtacagtctggacactattctccctggggccacggggaaccctggtcaccgtcc

SEQ ID NO: 786388 - DNA, 435 bp, Homo sapiens
  misc_feature: NA.4.14.B03.1.454.heavy.3.zerom50
tccgcggggatcactcaacaaccacatctgtcctctagagaaaaccctgtgagcacagctcctcaccatggactggacctggaggatcctcttcttggtggcagctgctacaagtgcccactcccaggtgcagctggtgcagtctggggctgaggtgaagaagcctggggcctcagtgaaggtctcctgcaagacttctggatacaccttcaccagttatgatatccactgggtgcgacaggcctctggacaagggcttgagtggatgggatggatgaacccaaacactggtgccacaggctatgcacagaggttccagggcagagtcaccatgaccagggacacctccataaggacagcctacatggagctgagcagcctcagatctgacgacacggccgtgtattactgtgcgaggcgcaaagggactaactt

SEQ ID NO: 786389 - DNA, 437 bp, Homo sapiens
  misc_feature: NA.22.56.F01.1.454.heavy.3.zerom50
tcggggttctcattcaccactgcttcagtgggtgtgggctggatccgtcagcccccaggaaaggccctggagtggcttgcactcctttatggggatggcggtgaacactacagtccatctctgaagaccagactcaccatcgcccgggacacctccaagaaccaagtggtccttacactgaccagcgtggaccctgtggacacaacaacatatttctgtgcacagagccgccagttagactggggggcctgtcgtggtggttggtgccgcaatgatgcatttcatatttggggccaagggacagtggtcaccgtctcggcagcctccaccaagggcccatcggtcttccccctggcgccctgctccaggagcacctccgagagcacagcggccctgggctgcctggtcaaggactacttccacgcgtatgtagtcca

SEQ ID NO: 786390 - DNA, 470 bp, Homo sapiens
  misc_feature: NA.51.13.B02.2.454.heavy.3.zerom50
tccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagaggttcgcttactggttcgaggctctccccacgg

SEQ ID NO: 786391 - DNA, 492 bp, Homo sapiens
  misc_feature: NA.51.13.B02.3.454.heavy.3.zerom50
ctgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggrgccaagggaccacggtcaccgtctccttagcctccaccaagggscccatcggtcttccccctggcaccctcctccaagagcacctcg

SEQ ID NO: 786392 - DNA, 473 bp, Homo sapiens
  misc_feature: NA.10.12.B01.1.454.heavy.3.zerom50
tccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctacttttgtgcgactagaagtgggagctagtaggggattttgattccgg

SEQ ID NO: 786393 - DNA, 479 bp, Homo sapiens
  misc_feature: NA.47.35.D02.1.454.heavy.3.zerom50
ttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtagtactgtatctggaaatgaacaatctgagagtcgacgatacggctgttctatccagttgtgttttcgattgcctttcggtccgcgggacttcgtggggccgarggtaacccg

SEQ ID NO: 786394 - DNA, 471 bp, Homo sapiens
  misc_feature: NA.49.49.E05.2.454.heavy.3.zerom50
aacacacaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccgaggcaagggggctggagtgggtggcagttatgtcatatgatggaagtaatatatactatatagactccgtgaagggccgattcatcatctccagagacaattccgagaacacgctgtatctgcaaatagaacagcctgagtaggttggacgggacgacggctcgttgtaatttatttgtgtacgaactttawyacsgacggtac

SEQ ID NO: 786395 - DNA, 467 bp, Homo sapiens
  misc_feature: NA.21.17.B06.1.454.heavy.3.zerom50
agggggagacgagccccagccttgggattcccaagtgttttcattcagtgatcaggactgaacacagaggactcaccatgaagtttgggctgagctgggtcttcctcgttgctgttttaaaaggtgtccagtgtgaaatacagctggtggagtctgggggagccttggtgaagccgggggggtcactcagactctcctgctctgcatctggttttatgataagtgatgcctggatgcactgggtccgccaggcaccagggaaggggctggagtgggtcggccgtattagagggcgaagtgctggtggggcgatagaatactctgcagccgtgagaggcagattcaccatcttcagagatgattcgagaaacacgatgcttctgcagatggatagcctgagaaaccgaggaacacaggcctactattattgttccagagatattaactccggtgactacggccttacg

SEQ ID NO: 786396 - DNA, 452 bp, Homo sapiens
  misc_feature: NA.4.20.B09.1.454.heavy.3.zerom50
aggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaaggtctcctgcaagacttcaggttacacctttagaaactatcctatcacctgggtgcgacaggcccctggacaagggcttgagtggatgggatggatcagcgcttacagtggtaacgcaatctatgcacagaggctccagggcagagtcaccatgaccacagacacatccacgagcacagcctacatggaactgacgagcctgagatctgacgacacggccgtttattactgtgcgcgaggggctgtcgagtacagcagcacgtccggctactttgactta

SEQ ID NO: 786397 - DNA, 421 bp, Homo sapiens
  misc_feature: NA.13.6.A06.2.454.heavy.3.zerom50
agggcttctggaggctccttcaccacttatgctatcagctgggtgcgacaggcccctggacaagggcttgagtggatgggagggatcacccctctgtctaatacagcagactacgcacagaagttccagggcagagtcacaattaccgcggacgcatccacgagcacagcttacatggagctgagaagcctgagatctgaggacacggccgtgttttactgtgcgagacgaggttgtaccagtactaactgctacaccacaaatcactactttgactcctggggccagggaaccctggtcaccgtctcctcagcctccaccaagggcccatcggtcttcccctggcgccctgctccaggagcacctccgagagcacagcggccctgggctgcctggtcaaggactacttccgtactagacg

SEQ ID NO: 786398 - DNA, 457 bp, Homo sapiens
  misc_feature: NA.52.46.E02.1.454.heavy.3.zerom50
ctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggggggctggtccagcctgggaggtccctgagactctcctgtgcaggctctgcatttcccttcagtaactatgctatcgattgggtccgccaggctccaggcgggggactggagtgggtggcagttatatcagctgatggaggccttaaatattacgcagattctgcgaggggccgagttcaccatatccagagacaactacccaagatatgatatatctacaaatgaacagcctgagaacctgaggacacggckwgtatattattgtgtcggtcrrgggggcaaggtgccgtggmccg

SEQ ID NO: 786399 - DNA, 448 bp, Homo sapiens
  misc_feature: NA.48.17.B06.1.454.heavy.3.zerom50
agggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 786400 - DNA, 323 bp, Homo sapiens
  misc_feature: NA.49.61.F06.2.454.heavy.3.zerom50
ctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 786401 - DNA, 456 bp, Homo sapiens
  misc_feature: NA.49.61.F06.4.454.heavy.3.zerom50
tctgggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggctccaggcaagggggctggagtgggtggcacttatatcaaatgatggaagaattcaacactacgcaggctccgtgaagggccgattcaccatctccagagacaattccaagaacacactgtctctgcaaatgaatagcctgagagttgaggacacggctgtctattactgtgcgagagctaaggggacttactcatagatttgta

SEQ ID NO: 786402 - DNA, 348 bp, Homo sapiens
  misc_feature: NA.47.41.D08.1.454.heavy.3.zerom50
actggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 786403 - DNA, 468 bp, Homo sapiens
  misc_feature: NA.4.9.A09.1.454.heavy.3.zerom50
agggggagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtctgggggaggcttggtacagcctggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtcg

SEQ ID NO: 786404 - DNA, 364 bp, Homo sapiens
  misc_feature: NA.22.80.H03.1.454.heavy.3.zerom50
aagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaggacctcatacgattttttggagtggttatttcccccctcctgactactggggccagggaaccctggtcaccgtctcctcagcctccaccaagggcccatcggtcttccccctggcaccctcctccaagagcacctctgggggcacagcggccctgggctgcctggtacaaggactacttccacgcgtatgt

SEQ ID NO: 786405 - DNA, 334 bp, Homo sapiens
  misc_feature: NA.13.59.F04.2.454.heavy.3.zerom50
tagggattggggaaatctatcatagtgggaccacctactacagcccgtccctcaatagtcgcgtcaccatgtcagtggacgagcccaagaaccagttctycctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttcctagtacgtga

SEQ ID NO: 786406 - DNA, 469 bp, Homo sapiens
  misc_feature: NA.51.54.E10.1.454.heavy.3.zerom50
aacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgacatttgacgacacggccgtctattactgtgcgacagaagcggcggacagaggttcgcttactggttcgaggctcccs

SEQ ID NO: 786407 - DNA, 484 bp, Homo sapiens
  misc_feature: NA.51.54.E10.2.454.heavy.3.zerom50
aacacacaaaggggtctgagagaggagcccagccctgggattttcaggtgttttcatttggtgatcaggactgaacagagagaactcaccatggagtttgggctgggctggctttttcttgtggctactttaaaaggtgtccagtgtgacgtccaactggtggagtctgggggacgcctggtgcgcccgggagggtccctgagactctcctgtgtggcctctgaattcacctttagagtctatgccatgagctgggtccgccaggctccagggaagggcctagagtgggtctcaggtatcagtggtaatgatggtaccacaaactacgcagaatccgtgaagggccggttcaccatctccagagacaattccaagaatctgctctttctgcaaatgaacagcctgagaatcgaggacacggccctatattattgtgtcaaagaagatggaccagttggacgaggamgccctatgggccgggtcc

SEQ ID NO: 786408 - DNA, 492 bp, Homo sapiens
  misc_feature: NA.5.64.F09.1.454.heavy.3.zerom50
agggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggagggatcgtccctgtctttggagcagcaaactacgcacatgatttccaggggagagtcacgattacggcggacgaatctacggccacagcctatctggagctgaacaacgtgagacctgaagacacggccgtttactactgcgcgagagatcgcccccccgaaggggccgaacgaggtataggtgggggcaacggcttttgggccttctactactactacgtaa

SEQ ID NO: 786409 - DNA, 475 bp, Homo sapiens
  misc_feature: NA.40.77.G11.1.454.heavy.3.zerom50
aagggaaaggggagggtgacaactatgcaaatgcaagtgggggcctccccacttaaacccagggctcccctccacagtgagtctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaraaagcccggggagtctctgaagatctcctgtaagggttttggatacarctttaccawckactggatcgsctgggtgcgccagatgcccgggaaaggcctrgagtggrtgggratcgatctatcytgrygactctgataccagatacagcccgtccttccaaggccaggtcaccatmtcagscgacargtccrycaryaccgcctacctgsagtggagyagyctsmaggcctcggacaccgccatgta

SEQ ID NO: 786410 - DNA, 351 bp, Homo sapiens
  misc_feature: NA.19.79.H02.1.454.heavy.3.zerom50
agggaaggggctggagtgggtgtcaacgattagtggaagtggtactggtatatactacgcagactccgtgaagggccggttcaccctctccagagacaattccaagaatacggtgtatctgcaaatgaacagcctgagagccgaggacacggccgtatattactgtgcgaatcaaaagttcggggacgtccgattcgatatggacgtctggggccaagggaccacggtcaccgtctcctcagcctccaccaagggcccatcggtcttccccctggcgccctgctccaggagcacctccgagagcacagcggccctgggctgcctggtcaaggactacttcccacgagagta

SEQ ID NO: 786411 - DNA, 442 bp, Homo sapiens
  misc_feature: NA.19.52.E08.1.454.heavy.3.zerom50
ccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaggcggt

SEQ ID NO: 786412 - DNA, 356 bp, Homo sapiens
  misc_feature: NA.2.71.G05.1.454.heavy.3.zerom50
ctggagtgggtttcatacattactagtagtggtagtaccatatattacgcagactctgtgaagggccgattcaccatctccagagacaacgcccagaactcactgtatctacaaatgaacagcctgagagccgaggacacggctgtttattactgtgcgagagaaacttacgatttttggagtggttattatacaccccgggaccttgactactggggccagggaaccctggtcaccgtctcctcagcttccaccaagggcccatcggtcttccccctggcgccctgctccaggagcacctctgggggcacagcggccctgggctgcctggtcaaggactacttcctgtcgagcgt

SEQ ID NO: 786413 - DNA, 465 bp, Homo sapiens
  misc_feature: NA.11.73.G07.1.454.heavy.3.zerom50
aggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgcgatcgacagaaaaagcggtggcctagtcggggtt

SEQ ID NO: 786414 - DNA, 453 bp, Homo sapiens
  misc_feature: NA.48.32.C10.1.454.heavy.3.zerom50
ctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtccccagggaaggggctggagtggattggaatttttatagcgggagcacctactataatccgtccctcaagagtcgagtcaccatatccgtagacacatccaagaaccagttctccctgaggctgagccctgtgaccgccgcagacacggctgtctattactgtgcgacccatcgatatcatgactggttgttagggcacgtctggggccaaggggaccacggtcaccgtctcctcgcg

SEQ ID NO: 786415 - DNA, 421 bp, Homo sapiens
  misc_feature: NA.48.32.C10.2.454.heavy.3.zerom50
agcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtgtattattgtgcgagagccgtcacg

SEQ ID NO: 786416 - DNA, 498 bp, Homo sapiens
  misc_feature: NA.2.11.A11.1.454.heavy.3.zerom50
agggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggcctcgggggctactggggccagggaaccatggtcaccgtctcctcagcctccaccaagggcccatcggtcttcccctggcaccctcctccaagagcacctctgggggcacagcggccctgggctgcctggtcaaggactacttcctgtcgagcgtcgtgtagcggcgtgcgrcgac

SEQ ID NO: 786417 - DNA, 290 bp, Homo sapiens
  misc_feature: NA.13.80.H03.1.454.heavy.3.zerom50
aagggaaagggccgattcaccatctccagagacaacgccaagaactccctgtatctgcaaatgaacagtctgagagctgaggacacggccttgtattactgtgcaaaaggtccatttagcagtggctggtcctcctactttgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 786418 - DNA, 442 bp, Homo sapiens
  misc_feature: NA.48.61.F06.2.454.heavy.3.zerom50
catcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaagatttcctgcaaggcatctggatacatcttcaccacctacaatatacactgggtgcgacaggcccctcgacaagggcctgagtggatggggatgatcaaccctaggtatggcagcacaagccacgcagagaagttccagggcagagttatcatgaccagcgacacgtccacgagcacagtctacatgagtctgagcagcctgagatctgaagacacggccgtctattactgtgscgaggagggggggtsgggtccccgaaggactacccg

SEQ ID NO: 786419 - DNA, 612 bp, Homo sapiens
  misc_feature: NA.48.61.F06.3.454.heavy.3.zerom50
agctctgggagaggagccccagccctgagaatcccaggtgtttccattcagtgatcagcactgaacacagaggactcaccatggagttggggactgagctggattttccttttgactattttaaaaggtggtcactgtgaacggctactggtggagtctgggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagcgagaagattgactatgcggagtctgtgaaggggcgattcatcatctccagagacaacgccaagaactccctgtatttgcagatgaacaatctgagacctgacgacacggccttgtattattgtgcaaaagttgtggagtcacagtctctgactacggtatggacgtctggggccaagggaccacggtcacagtctcctcagcctccaccaagggcccatcggtcttcccctggcaccctcctccaagagcacctctgggggcacagcggccctgggctgcctggtcaaggactacttcctatgtatact

SEQ ID NO: 786420 - DNA, 461 bp, Homo sapiens
  misc_feature: NA.48.61.F06.4.454.heavy.3.zerom50
tctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagkmgtgggacctactgttcctac

SEQ ID NO: 786421 - DNA, 258 bp, Homo sapiens
  misc_feature: NA.40.50.E06.1.454.heavy.3.zerom50
caccgccgaaaaccaggtggaccttagaatgaccaacatggaccctgtggacacaggcacatattactgtgctcacacgtcctacactggctacgactactacggtatggacgtctggggccaggggaccacggtcatcgtctcctcaacctccaccaagggcccatcggtcttccccctggcgccctgctccaggagcacctccgagagcacagcggccctgggctgcctggtcaaggactacttccagtcgctaga

SEQ ID NO: 786422 - DNA, 484 bp, Homo sapiens
  misc_feature: NA.26.63.F08.1.454.heavy.3.zerom50
agggggtctcagagaggagccttagccctggactccaaggcctttccacttggtgatcagcactgagcacagaggactcaccatggaattggggctgagctgggtcttccttgttgctattttagaaggtgtccagtgtgcggtgcagctggcggagtctgggggaggcttggtccggccgggggggtccctcagactctcctgtgtagcctctggattcacgtttaatgactattggatggcctgggtccgccatagtccagggaaaagactggagtgggtggccaaaatcaagccagatggaagtgaacaaaactatctgtattctgtgaagggccgattcactatctccagagacaacgacaaggactcagtgtctctgtacataaggagcctgagagtcgaggacacgggtgtcttctactgtgcgagaatcggcccgggcagttttgactcctggggccagggaaccgtggtcaccgtc

SEQ ID NO: 786423 - DNA, 496 bp, Homo sapiens
  misc_feature: NA.53.9.A09.1.454.heavy.3.zerom50
aggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggttgagtctgggggaggcttggtacagccagggcggtccctgagactctcctgtacaacttcaggattcacctttggtgattatgctatgacctgggtccgccaggctccagggaagggcctggagtgggtaggtttcgttagaagcaaaactgatggtgggacaacagaatacgccgcgtctgtgaaaggcagatttatcatctcaagagacgattccaaaggcatcgcctatctgcaaatgaacagcctagaaaaccgaggacacagccgtgtatttctgtactagagtcttcttgtattactatgatactagtggttttacaggtagtggggcgacggt

SEQ ID NO: 786424 - DNA, 454 bp, Homo sapiens
  misc_feature: NA.53.9.A09.2.454.heavy.3.zerom50
aggggctgaaagcatcatccaacaaccacatcccttctctacagaagcctctgagaggaaagttcttcaccatggactggacctggagggtcttctgcttgctggcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacagggggcttgagtggatgggtctaatcaaccctagtggtggatctacaagttactcacgagagaatgcagggccgaatttaccatgaccagacgacacgtccacgagtacagtctacatggaggtgagcagcctgagatctgaggacgacggccatgtattacgtgtgcgatcttagtggtattacgactaacaattta

SEQ ID NO: 786425 - DNA, 486 bp, Homo sapiens
  misc_feature: NA.49.71.G05.1.454.heavy.3.zerom50
agtctccttcaccacccagcggggatctcacggcttccttttctgtcctcctccaggatggggtcaaccgccatcctcgccctcctcctggctgttctccaaggagtctgtgccgaagtgcagctggtgcagcccggagcggtaatgaaaagcccggggagtctctgaggatctcctgtaagggttctggatacagctttagtaccttctggatcacctgggtgcgccagctgcccgggaaaggcctggaatggatggggaggattgaccccagtgactccagtaccaactacagtccgtccttcgaaggccacgtcagcatctcacttgacgtgtccaccaccactgtctacctacagtggcgcagcctcaagacatcggacaccgccacctattactgtgcacgacgccgttataccagaggctggtaccttgactcctcggggccaggggcaccctcggtcacccggtcctcccgtctaccgt

SEQ ID NO: 786426 - DNA, 478 bp, Homo sapiens
  misc_feature: NA.22.34.D01.2.454.heavy.3.zerom50
ttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 786427 - DNA, 446 bp, Homo sapiens
  misc_feature: NA.19.82.H05.1.454.heavy.3.zerom50
catcactcaacaaccacatctgtcctctagagaaaaccctgtgagcacagctcctcaccatggactgggcctggaggatcctcctcttggtggcagcagctacaagtgcccactcccaggtgctactggtgcagtctggggctgaggtgaagaggcctggggcctcagtgaaggtctcctgcaagacttctgggttccccttccaaaattttgatatcaattgggtgcgacaggccactggacaagggctcgagtggatgggatggatgaacggtaaaagtggaaacacaggctatgcggagagattccagggcagagtcaccatgactggggacccctctgtcggcacagcctacatggagctgagaagtctgacacctgaggacacggccgtctattactgtgcgagagccgcgaatatagaagtgcgggagagtggtacttcg

SEQ ID NO: 786428 - DNA, 469 bp, Homo sapiens
  misc_feature: NA.14.41.D08.1.454.heavy.3.zerom50
tctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtggggccggggaaccctggtcaccgtctcttcagcctccaccaagggcccatcggtcttcccctggccaccctcctccaagagcacctctgggggcacagccc

SEQ ID NO: 786429 - DNA, 455 bp, Homo sapiens
  misc_feature: NA.53.41.D08.1.454.heavy.3.zerom50
ctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaagggggctggagtgggtggcacttatatcagatgatggaagtgatacatactatggagactccgtgaagggccgattcaccatctcgagagacaattccaggaacacgctgtatctgcaaatgaacggcctwgagagctgaggacacggctgtgtattactgtgcgtaacggttgagtgggaagttaggggtcg

SEQ ID NO: 786430 - DNA, 474 bp, Homo sapiens
  misc_feature: NA.53.41.D08.2.454.heavy.3.zerom50
cctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatttcaaatgatggaagtaacaaatactatgtggactccgtgaagggccgattcaccatctccagagacaattccaagaatacgctgtatctgcacatgaacagcctgagagccgaagacacgggtgtttattactgtgcgaacttaattacggaggacaacggtaaccccgtccgcacggtacggtaccg

SEQ ID NO: 786431 - DNA, 426 bp, Homo sapiens
  misc_feature: NA.15.2.A02.1.454.heavy.3.zerom50
aggggtccctgagactctcttgtgcagcgtctggattcaccttcagaagttggggcatgcactgggtccgccaggctccaggcaaggggctgcaatgggtggcgctaatatgggatgacggaagtaaggaatattatgcagactccgtgaagggccgattcaccatctaccagagacaattccaagaagacgctgtttctgcaaatgaacagcctgagagtcgaggacacggctgtatattattgtgcgcgagaggggttggtagcacggtcactggactactggggccagggaaccctggtcaccgtctcctcagcctccaccaagggcccatcggtcttccccctggccaccctcctccaagagcacctctggggacacagcggccctgggctgcctggtcaaggactacttccgctacgtaga

SEQ ID NO: 786432 - DNA, 436 bp, Homo sapiens
  misc_feature: NA.48.36.D03.1.454.heavy.3.zerom50
atctctcttgggggcatcacataacaaccacatccctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcagtgaaggtctcctgccaggcttctggaggcaccttcagcagcaatgctatcaactgggtgcgacaggcccctggacaagggcttgagtggatgggagggatcatccctatgtttgctacaacaaactacgcacagaagtttcagggcagaatcacgattaccgcggacgaatccacgagcacagcctacatggagctgagcagcctgacatcagaggacacggccatttattactgtgcgagagtagttcgactt

SEQ ID NO: 786433 - DNA, 447 bp, Homo sapiens
  misc_feature: NA.53.41.D08.4.454.heavy.3.zerom50
agcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtcccccggactttgtacg

SEQ ID NO: 786434 - DNA, 446 bp, Homo sapiens
  misc_feature: NA.53.41.D08.6.454.heavy.3.zerom50
tgtacacctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatcctggggccgagggaccacggtcaccgtctcctcagcctccaccaagggcccatcggtcttcccctggcgccctgctccaggagcacctccgagacgcacagccggccctggggcctgccyggtcaaggactacttcctcgtactgtcg

SEQ ID NO: 786435 - DNA, 463 bp, Homo sapiens
  misc_feature: NA.51.33.C11.1.454.heavy.3.zerom50
ttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgacaaaagcccaaggcaacagcygkta

SEQ ID NO: 786436 - DNA, 417 bp, Homo sapiens
  misc_feature: NA.4.82.H05.1.454.heavy.3.zerom50
agagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagaagcctggggcctcagtgatggtctcctgcaaggcttctggattcaccttcaccggctactatttgcactgggtgcgacaggcccctggacaagggcttgagtggatgggatggatcaaccctaatagtggtgccacacactatgcacagacttttctgggcagggtcaccatgaccagggacacgtccatcagcacagcctacatggagctgagcaggctgagatctgacgacacggccgtgtattactgtgtgtctgtg

SEQ ID NO: 786437 - DNA, 482 bp, Homo sapiens
  misc_feature: NA.51.33.C11.3.454.heavy.3.zerom50
ttgggtttggggacccaaaaaccacacccctccttgggagaatcccctagatcacagctcctcaccatggactggacctggagcatccttttcttggtggcagcagcaacaggtgcccactcccaggttcagctggtacagtctggagctgaagtgaagaagcctggggcctcagtgaaggtctcctgcaaggcctctggttacacctttatgaattatggtatcagctgggtgcgccaggcccctggacaagggcttgagtggatgggatggatcagcgcttacactggtgacacaaagtatgcacagaaactccagggccagagtcaccatggaccacagacacgtccacgagcacagcctacatggaactgagggagcctgggatctgacgacacggccgtggttattactgttgcggagagagtaggccccgaaggggggagaaggtaggttggtttttccgaccgtctggtcgatta

SEQ ID NO: 786438 - DNA, 470 bp, Homo sapiens
  misc_feature: NA.21.19.B08.1.454.heavy.3.zerom50
aggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagtagtttcatatattacgcagactcagtgcagggccgattcaccatctccagagacaacgccaagaattccctgtatctgcaaatggacagcctgagagtcgaggacacggctatgtattactgtgcgggtggcgtggggcggggatgacagctggggccacgtaacccg

SEQ ID NO: 786439 - DNA, 369 bp, Homo sapiens
  misc_feature: NA.19.12.B01.1.454.heavy.3.zerom50
ttkgggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagta

SEQ ID NO: 786440 - DNA, 363 bp, Homo sapiens
  misc_feature: NA.51.70.G04.1.454.heavy.3.zerom50
actggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 786441 - DNA, 470 bp, Homo sapiens
  misc_feature: NA.14.21.B10.1.454.heavy.3.zerom50
aggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagtatttttggagtggttattatacctttgacttcggtc

SEQ ID NO: 786442 - DNA, 473 bp, Homo sapiens
  misc_feature: NA.51.70.G04.3.454.heavy.3.zerom50
actttctgagactcatggacctcctgcacaagaacaagaaacacctgtggttcttcctcctcctggtggcagctcccagatgggtcctctctcaggtgcagctgcaggagtcgggcccaggactggtgaagccttcggggaccctgtccctcacctgcgctgtctctggtgtctccatccgcagtcctaattggtggagttgggtccgtcagcccccagggaagcggctggagtggattggggaaatctatcatactgagaacaccaactacaacccgtccctcgagagtcgagtcaccatgtcaatagacaagggcaacaatgagttctccctgaatctgcggtctgtgaccgccgcggacacggccgtgtattattgtgtgagagatcggcaagatagtagtggttattacatcggtgactacgacggtatggacgtctgggggccaagggaccacgggtcatcgtctccc

SEQ ID NO: 786443 - DNA, 474 bp, Homo sapiens
  misc_feature: NA.51.70.G04.5.454.heavy.3.zerom50
catcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccggggcaaagtcacgttgaccgcgggacacagtcacggacacagcctacatggaactcaacggcctcagatttgaggacacggccgtctattattgtkkcgagagtgagaaattacggtggctactcccttgactactgggggccagggaaccctggtcctacccg

SEQ ID NO: 786444 - DNA, 502 bp, Homo sapiens
  misc_feature: NA.53.65.F10.2.454.heavy.3.zerom50
aggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtctgggggaggcttgatacagcctggggggtccctgagactctcctgtgcagcctctggattcacctataacagtcacgccatgaactgggtccgccaggctcccgggaaggggctggagtgggtctcaggtattagtggcagtggtggaatcacatactacgcagactccgtgaagggccggttcaccatctccagagacaactccaagaacacactgtttctacaaatgaatagcctgagagccggcggacacsgscgtatattattgtgcgtaaaggtttgggggttggcrarttggagttgggtttttaagtatcccgtattgtactacgtgggggccgtac

SEQ ID NO: 786445 - DNA, 437 bp, Homo sapiens
  misc_feature: NA.48.56.F01.2.454.heavy.3.zerom50
aacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtgtatttattgtgcgagagcctcacgg

SEQ ID NO: 786446 - DNA, 503 bp, Homo sapiens
  misc_feature: NA.17.80.H03.1.454.heavy.3.zerom50
aagggaaaggggacccaaaaaccacacccctccttgggagaatcccctagatcacagctcctcaccatggactggacctggagcatccttttcttggtggcagcagcaacaggtgcccactcccaggttcaactggtgcagtctggaggtgaggtgaagaagcctggggcctcagtgaaggtctcctgcaaggcctctggttacacctttaccaactatggtattagttgggtgcggcaggcccctggacaagggcttgagtggatgggatggatcagccctaacattggtaaaaacaaattatgcacagaggctccagggtagagtcaccctgaccacagacacatccactaacacagcctacatggaactgaggaccttgagatttgacgacacggccttctattactgtgcgagagtgagaggggcggtggtagctgctaccggccgtggggttcgaccacgtggggccagggaaccctggtcaccgctcgttccgtccc

SEQ ID NO: 786447 - DNA, 499 bp, Homo sapiens
  misc_feature: NA.40.53.E09.1.454.heavy.3.zerom50
ttgggtttggggacccaacaaccacattgggtttggggagcccccagagcacaactccttaccatggactggacctggaggatcctctttttggtggcagcagccacaggtgcccactcccaggtccagcttgtgcagtctggggctgaggtgaagaagcctggggcctcagtgagggtttcctgcaaggcgtctggatattccttcactacctacactctgcattggctgcgccaggcccccggacacagctttgagtggatggggtggctcaacgctggcgatggaaaaacaaatattcagagaagttccagggcagagtcaccattacaagggacacaatcgcgcgcaatgcttacatggagttgaggagcctgagatctgaagacacggctgtgtattactgtgtgagaggcggatattgtcgtggtggtgactgctacagtcaaaatcgtcggtggtggttcgaccccgtggggccgagggaacccctcgtccg

SEQ ID NO: 786448 - DNA, 464 bp, Homo sapiens
  misc_feature: NA.4.81.H04.1.454.heavy.3.zerom50
agctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacaacgccaagaactcagtgtttctgcaaatgaacagcctgagagtcgaggactcggctgtctactactgtgcgaggaataagggagctaccctacgatttggacacggta

SEQ ID NO: 786449 - DNA, 487 bp, Homo sapiens
  misc_feature: NA.17.74.G08.2.454.heavy.3.zerom50
agggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggagacctagttcagcctggggggtccctgagactctcctgtgcagcctctggattcacctttcagtacctactggatgcactgggtccgccaagctccagggaaggggctggagtggctctcacgtgttgataatgttggcagtttcacaaaatacgcggactccgtgaagggccgattcaccatctccagagacaacgccaagaaccacgctgtatctgcaaatgaacagtctgagagccgaggacacggctygtttattactgtcgcaagacagacactacagtcacttaccttcgaccccgtggggscsaggggamccctsggtcstacccg

SEQ ID NO: 786450 - DNA, 480 bp, Homo sapiens
  misc_feature: NA.48.16.B05.1.454.heavy.3.zerom50
agggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattacctgtgcggagggggccgggatagttgttatagaaccacctgcctatctgagctggttcgactgctgggggccaggggaacccctggtcgtacccg

SEQ ID NO: 786451 - DNA, 475 bp, Homo sapiens
  misc_feature: NA.52.31.C09.1.454.heavy.3.zerom50
aagactgacggtcctcccaggagttcaggtgctgggcaccgtgggcatgggggaggcgtggtccggcctgggaggtccctgagactctcctgtgcagcctctggattcaccttcaatgtctatggcatgcactgggtccgccaggctccaggcaagggrctggagtgggtggcgtttatatcatctgatggaagtaataaaactatgtagactccgtgaagggccgattcaccatctccagagacaattccaagagcactctgtatctgcaaatgaaacagccctgagagctgaggacacggctatttattactgtgcgaaagatacctattactatgatgctagtgktcctacactggaccaatggggccagggaacccgtggtcaccgtctcctcagcttccaccaagggcccgatccggtccttccccygkcsgycctgcycswsgwscrcctcwcggaaggcacctccgtc

SEQ ID NO: 786452 - DNA, 460 bp, Homo sapiens
  misc_feature: NA.9.82.H05.1.454.heavy.3.zerom50
tctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatatacgggtcgacaacggtggctacgcgttt

SEQ ID NO: 786453 - DNA, 485 bp, Homo sapiens
  misc_feature: NA.22.65.F10.1.454.heavy.3.zerom50
aggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagcctggagggtccctgagactctcctgtgcagcctctggattccccttcagtgacttctacatgaattggatccgccaggctccagggaaggggctggagtgggtttcatacattagtggtagtggtatttttaaatacgcagactctgtgaagggccgattcaccatctccagggacaacgccaagaactcactgtatctgcaaatgaacagcctgagagtcgaggacacggccgtgtattattgtgcgggaagaggatcggggcagttatgctttcgaccccttgggggccaggggaaccctc

SEQ ID NO: 786454 - DNA, 478 bp, Homo sapiens
  misc_feature: NA.13.36.D03.2.454.heavy.3.zerom50
atctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatgggatggatcgacatcaacactgggaacccaacgtatgcccagggcttcacaggacggtttgtcttctccttggacacctctgtcagcacggcgtatgtacagatcagcagcctaaaggctgaggacactgccatttattactgtgtgagagattctttccttgactacggtacttctggtccttgactacttggggccaggggtaacccg

SEQ ID NO: 786455 - DNA, 504 bp, Homo sapiens
  misc_feature: NA.13.36.D03.3.454.heavy.3.zerom50
atctctcttgggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgaggggccggttcaccatctccagagacaattccaagaacacggtgtatcttcaaatgaacgacctgagagtcgaggacacggccgtctattactgtgcgaaagatrgcagagagggcccccgtaatrggggcctggtggagggttcttctttgacgtscaagggaccgtacc

SEQ ID NO: 786456 - DNA, 487 bp, Homo sapiens
  misc_feature: NA.22.43.D10.1.454.heavy.3.zerom50
agggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatggggtctcagttattcataccgacggtaccatatatgacgcagactccgtgaagggccgattcaccatctcccagagaccattccaagaacaccctaatatcttcaaatgaacaacctgagagtcgaagacacggccgtatattactgtgcgagacatgacttcggtcgacccctggggccgagggaaccctcggtaccgaccgtctcctcag

SEQ ID NO: 786457 - DNA, 485 bp, Homo sapiens
  misc_feature: NA.3.56.F01.1.454.heavy.3.zerom50
aacacacaaagggggctctccaccatggacatactctgttccacgctcctgctactgactgccccgtcctgggtcttatcccaggtcaccttgagggagtctggtcctgcgctggtgaaacccacagagaccctcaccctgacgtgcaccttctctggcttctcactcagttccagtggaatgtgtgtgagctggatccgtcagcccccagggaaggccccggagtggcttgcactcattgatgggaatgatgataaatacttcagcaaatctctggagaccaggctcaccatctccaaggacacctccaaaaaccaggtagtccttataatgaccaacatggaccctgtggacacagccacgtattactgtgcccggaccccccgcacccgctcggggtattccaccccaattccactacaaaatggacgtctgggcaaagggaccacggtcatcgtctcctcagcctccaccaagggcccacg

SEQ ID NO: 786458 - DNA, 338 bp, Homo sapiens
  misc_feature: NA.51.72.G06.2.454.heavy.3.zerom50
ctggagtgggtggcagttatatcatatgatggaaagaataaatactatggagactccgtgaagggccgattcaccatctctagagacaatctcaaggagacagtgcatctgcaaatgaacagcctgagaggtgacgacacggctgtgtattactgtcacctcgagagcagcaattggagagaggtttttgatatctggggccaagggactatggtcaccgtctcttcagcctccaccaagggcccatcggtcttccccctggcaccctcctccaagagcacctctgggggcacagcggccctgrgctgcctggtcaaggactacttcctcgtagcact

SEQ ID NO: 786459 - DNA, 469 bp, Homo sapiens
  misc_feature: NA.14.12.B01.2.454.heavy.3.zerom50
ttgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggsccagggaaccctggtcaccgtctcctcagcctccaccaagggcccatcggtcttcccctcggcaccctcctccaacgacg

SEQ ID NO: 786460 - DNA, 321 bp, Homo sapiens
  misc_feature: NA.16.17.B06.2.454.heavy.3.zerom50
aggggggggttccaactacaatccgtccctcaagagtcgactcaccctttcggtggacaagtccaagaaccacttctccctgcggttatgttctgtgaccgccgcggacacggccgtgtattactgtgcaaaaacttacgacttttggagtggacctgttccggacatgttcgacccctggggccaaggaaccctggtcaccgtctctccagcttccaccaagggcccatccgtcttccccctggcgccctgctccaggagcacctccgagagcacagccgccctgggctgcctggtcaaggactacttccgagtagtaca

SEQ ID NO: 786461 - DNA, 465 bp, Homo sapiens
  misc_feature: NA.49.76.G10.1.454.heavy.3.zerom50
aagggggcatcatccaacaaccacatcccttctctacagaagcctctgagaggaaagttcttcaccatggactggacctggagggtcttctgcttgctggctgtagctccaggtgctcacttccaggtgcagctggtgcagtctggggctgaggtgaagaagcctggggcctcagtgaaggtttcctgcaaggcatctggatacaccttgaccaactactatatacaatgggtgcgacaggcccctggacaaggacttgagtggatgggaataatcaaccctagcggtggaagtacaaccatcgcacagaaattccagggcagactcatcatgaccagggacacgtccacgagcaccgtctacatggaactgaacagcctgagatctgaggacactgccgtgtattactgtgcgagggagtaccgttttatcgtgggacgtcgccccaaaatccaccgttcttac

SEQ ID NO: 786462 - DNA, 466 bp, Homo sapiens
  misc_feature: NA.14.39.D06.2.454.heavy.3.zerom50
cagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtcctggggccaaggggaccacggtcaccgtctcctcagcctccaccaagggccc

SEQ ID NO: 786463 - DNA, 447 bp, Homo sapiens
  misc_feature: NA.53.56.F01.1.454.heavy.3.zerom50
aacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacgtccatcagcacagcctacatggagctacacggcctgagatctgacgacacggccctgtatttttgtgcgagagagtctattaaagtggcttc

SEQ ID NO: 786464 - DNA, 477 bp, Homo sapiens
  misc_feature: NA.14.33.C11.2.454.heavy.3.zerom50
ttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgaccacggccgtttattattgtgcaaattaagaaattgacaaacgatrkcttttrkatatggtggggccgaagggactacg

SEQ ID NO: 786465 - DNA, 424 bp, Homo sapiens
  misc_feature: NA.12.81.H04.1.454.heavy.3.zerom50
tccctgagactctcttgtgcaggctctggactcagcattagcaattatgccgtgagctgggtccgccaggttgcaggaaagggtctggaatgggtctcagtaattagtcatagtggtgatgtcacactctacgcggactccgtgaagggccggttcaccatctccagagacaattccaagaacacagtgtatttgcaaatgaacagcctgaaagccgatgacacggccatatattattgtgtgagagatgacgaaagcgaatatccattcgatcttgactactggggccagggaacccttgtcaccgtctcctcagcctccaccaagggcccatcggtcttcccctggcgccctgctccaggagcacctccgagagcacagcggccctgggctgcctggtcaaggactacttcctacgtcgtat

SEQ ID NO: 786466 - DNA, 482 bp, Homo sapiens
  misc_feature: NA.2.21.B10.1.454.heavy.3.zerom50
agagagagaggtgccttagccctgaattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattactagtagtggtagtaccatatattacgcagactctgtgaagggccgattcaccatctccagagacaacgcccagaactcactgtatctacaaatgaacagcctgagagccgaggacacggctgtttattactgtgcgagagaaacttacgtatttttggagttggttattataccaccccgggaccttcgtaccg

SEQ ID NO: 786467 - DNA, 458 bp, Homo sapiens
  misc_feature: NA.53.28.C06.1.454.heavy.3.zerom50
ctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgcttttgattg

SEQ ID NO: 786468 - DNA, 341 bp, Homo sapiens
  misc_feature: NA.16.70.G04.1.454.heavy.3.zerom50
ctggagtggatcgggaatatctattatagtgggagcacctactacaacccgtccctcaagagtcgagtcgccatatccgtagacacgtccaagaaccacttctccctgaaactgagctctgtgaccgccgcagacacggctgtctattactgtgcgagacagagttacgacggtggttactccggtctctttgacaactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 786469 - DNA, 469 bp, Homo sapiens
  misc_feature: NA.52.26.C04.2.454.heavy.3.zerom50
tctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccgaggggggcgggagcasscccgtaacttctggggccaac

SEQ ID NO: 786470 - DNA, 509 bp, Homo sapiens
  misc_feature: NA.13.40.D07.1.454.heavy.3.zerom50
taacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctccaccaagggcccatcggtcttcccctggccaccctcctccaagacgcacctctgggggcacgagcggccctgggctgcctcgtmcgttc

SEQ ID NO: 786471 - DNA, 618 bp, Homo sapiens
  misc_feature: NA.49.70.G04.2.454.heavy.3.zerom50
ctctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggyaaggggctggagtgggtggcatttatatcatatgatggaagcaagatatactatgtagactccgtgaagggccgattcatcatctccagagacaactccgagaacacgctgtatctgcaaatgaacaggctgagagctgaagacacggctttatattactgtgcgaacttaatcacggaggacaacggtgaccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 786472 - DNA, 479 bp, Homo sapiens
  misc_feature: NA.49.70.G04.5.454.heavy.3.zerom50
agctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccgggggggtccctgagactctcctgtgcagcctctggattcaccttccgttcctataccatgaactggatccgccaggctccagggaggcgactggagtgggtctcatctattagtggtagaggtgattactacaactacgcagactcactggagggccgattcaccatctccagagacaacaccaagaatttactgtatctgcaaatggacagcctgagagccgacgacacggctgtctattactgtgcgagagttcgggatattgtccgtagtcccagtatgtccccgaccactggttccg

SEQ ID NO: 786473 - DNA, 488 bp, Homo sapiens
  misc_feature: NA.8.10.A10.1.454.heavy.3.zerom50
agggtcttcgtggctcacgtccaccaccacgcatgtgacctcaggggtccgggagatcatgagggtgtccttgggttttggggggaagaggaagactgacggtccccccaggagttcaggcccctggacaagggcttgagtggattggatggatcagcgcttacaatggtaagacatacacaaactatgcacagaagttccagggcagagtctccatgaccatagacacatccgcgaccacagcctatatggagttgacgagcctgagatctgacgacacggccgtgtattactgtgcgagggatgtagtagtgacgtggtacgccggggggaaacttgactactggggccagggatccctggtcaccgtctcctcagcctccaccaagggcccatcggtcttccccctggcaccctcctccaagagcacctctgggggcacagcggccctgggctgcctggtcaaggactacttccgacacgcgacg

SEQ ID NO: 786474 - DNA, 411 bp, Homo sapiens
  misc_feature: NA.8.10.A10.2.454.heavy.3.zerom50
aggggtccgggagatcatgagggtgtccttgggttttggggggaagaggaagactgacggtccccccaggagttcaggtgcccactcccaggttcagctggtgcagtctggagctgagaagttccagggcagagtctccatgaccatagacacatccgcgaccacagcctatatggagttgacgagcctgagatctgacgacacggccgtgtattactgtgcgagggatgtagtagtgacgtggtacgccggggggaaacttgactactggggccagggatccctggtcaccgtctcctcagcctccaccaagggcccatcggtcttccccctggcaccctcctccaagagcacctctgggggcacagcggccctgggctgcctggtcaaggactacttccgacacgcgag

SEQ ID NO: 786475 - DNA, 364 bp, Homo sapiens
  misc_feature: NA.3.45.E01.1.454.heavy.3.zerom50
ctggagtgggtggccaacatagagtacgatggaagtgagaaaactatgtggactccgtgaagggccgattcaccatctccagagacaacgacaagaatttagtgtatctgcaaatgagcagcctgagagccgaggacacggctgtgtattattgtgcgagagataaatattacgatttttggagtggttattatatctcaagtagcgactcgagaggctactggggccagggaatccaggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 786476 - DNA, 341 bp, Homo sapiens
  misc_feature: NA.16.72.G06.1.454.heavy.3.zerom50
ctggagtgggtctcatctattagtagtagtgatagtgccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 786477 - DNA, 282 bp, Homo sapiens
  misc_feature: NA.3.31.C09.1.454.heavy.3.zerom50
ccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 786478 - DNA, 451 bp, Homo sapiens
  misc_feature: NA.17.78.H01.1.454.heavy.3.zerom50
accatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccggacacagccttgagtggatgggatggatgaacgttgacaatgggaatacgagatattcacagaaattccagggcagagtcaccattaccagggacacatccgcgaacacagcctacatggagctgacgggcctgacatctgaagacacggctttatattactgtgcgcgagatggctggcacagagggcacaactggctcgaccccgg

SEQ ID NO: 786479 - DNA, 425 bp, Homo sapiens
  misc_feature: NA.19.68.G02.1.454.heavy.3.zerom50
cagagcctgctgaattctggctgaccagggcagtcaccagagctccagacaatgtctgtcgccttcctcatcttcctgcccgtgttgggcctcccatggggtgtcctgtcacaggtgcagctgcaacagtcaggtccaggactggtgaagccctcgcagagcctctcactcacctgtaccatctccggggacagtgtctctagtgacagcgcaacttgggactggctcaggcagtccccatcgagaggccttgagtggctgggaaggacatactacaggtccacgtggtatgatgattatgcagtatctgtgaaaagtcgatttaccattaagccagacacatccaagaaccagttctccctgcacttgaactctgtgactcccgacgacacggctgtctattactgtgcaagagctcgcaaggg

SEQ ID NO: 786480 - DNA, 338 bp, Homo sapiens
  misc_feature: NA.40.41.D08.1.454.heavy.3.zerom50
ctggagtgggttggccgtgttaagaccaaacctgagggtggggcaatagactacgctgcacccgtgacaggcagattcgccatctcaagagatgattcagcaggcacggtgtatctggaaatgaacagcctgaaagccgaggacacagccgtgtattattgtaccgcagggctcggctactccgatactgactattggggccagggaaccctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 786481 - DNA, 457 bp, Homo sapiens
  misc_feature: NA.3.23.C01.2.454.heavy.3.zerom50
tagggattggggctgaggtgaagaagcctggggcctcagtgaaggtctcctgcaaggcgtctggatacgacgtcagcaggaggtatatacactgggtgcgacaggcccctggacaaggccttkagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttctggggccagggaaccctggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 786482 - DNA, 486 bp, Homo sapiens
  misc_feature: NA.40.21.B10.1.454.heavy.3.zerom50
agggggtctcagagaggagccttagccctggactccaaggcctttccacttggtgatcagcactgagcacagaggactcaccatggaattggggctgagctgggttttccttgttgccattttagaaggtgtccagtgtgaggtgcagttggtggagtcggggggagacttggtccaggctggggggtccctgagactctcctgtgcagcctctggattcagctttagtaggtattggatgagctgggtccgccaggctccagggaagggactggagtggatggccaacataaaggaagacggaagtgacaaaaagtatgtggactctgtgagcggccgatttaccatctccagagacaacgccaagaactcactgtatctgcaaatgaacaacctgagagccgaggacacggctgtgtaattactgtgtgaggagatttcaacgttcccgagtttggttacggtgggtggctagggtgcttaacg

SEQ ID NO: 786483 - DNA, 363 bp, Homo sapiens
  misc_feature: NA.13.25.C03.2.454.heavy.3.zerom50
tgcgccaggcccctggacaaggccttgagtggatgggatggatgaaccctgagagtggtaacacaggctatgcacagaagttccagggcagactcaccatgacctgggacacctccataagcacagcctacatggagctggagcagcctgcgatctgaggacacggccatgtattactgtgcgagatttcaaaggaattacctgccgtacatggacgtctggggcgaggggaccacggtcaccgtctcctcagcctccaccaagggcccatcggtcttccccctggcgccctgctccaggagcacctccgagagcacagcggccctgggctgcctggtcaaggactacttcctagtacgtcga

SEQ ID NO: 786484 - DNA, 471 bp, Homo sapiens
  misc_feature: NA.21.34.D01.1.454.heavy.3.zerom50
ttgggtttgggggaggcttggtccagcctggggggtccctgagagtctcctgtgtggcctctggattcaagtttaatacctattggatgagctgggtccgccaggctccagggaaggggctggagtgggtggccaacataaaggaagatggaagtgacaaaaagtatgtggactctgtgaagggccgattcaccatcttcagagacaacgccaagaactcactttatctgcaaatgaatagcctgagagtcgaagacacggctgtgtattactgtgcgagagatagcgaggaggtggagcagctcgtcgatttgtactacatggacgtctggggcaaagggaccacggtcaccgtctcctcagcctccaccaagggcccatcggtcttcccctggcaccctcctccaagagcacctctgggggcacagcggccctgggctgcctggtcaaggactacttcccgagcgacga

SEQ ID NO: 786485 - DNA, 464 bp, Homo sapiens
  misc_feature: NA.5.78.H01.1.454.heavy.3.zerom50
tgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatgactccgtgaagggccgattcaccatctccagagacaattccaagaacactctgtatctgcaaatggacagcctgagacctgaggacacggctgtgtattactgtgcgaaagaaaccggcgggcagtggctgggcccatttgaccactggggccagggaaccctggtcaccgtctcctcagcctccaccaagggcccatcggtcttcccctggcaccctcctccaagagcacctctgggggcacagcggccctgggctgcctggtcaaggactacttcccgg

SEQ ID NO: 786486 - DNA, 488 bp, Homo sapiens
  misc_feature: NA.53.39.D06.1.454.heavy.3.zerom50
cagttctttggggatgcagttctttggggggatctcatgtgcaagaaaatgaagcacctgtggttcttcctcctgctggtggcggctcccagatgggtcctgtcccagctgcagctgcaggagtcgggcccaggactggtgaagccctcggagaccctgtccctcacctgcactgtctctggtgcctccatcagcacaagtaatcactactggggctggctccgccagcccccagggaaggggctggagtggattgggagtatgtattatggtggggccacctactacaacccgtccctcaagagtcaagtcaccatatccgtagacacgtccagcaaccagttctccctgaggctgtcctctgtgaccgccgcagacacggctgtctattactgtgcgagacatgtggggccagtgggagtggtcgtacaactggttcgacccctggggccagggaaccctggtcaccgtctcctcagcctccaccg

SEQ ID NO: 786487 - DNA, 457 bp, Homo sapiens
  misc_feature: NA.51.82.H05.2.454.heavy.3.zerom50
cacgaccggtgctcgatttagtrymswcrctwagrgakwggggkctgggagacgagcccagcactggaagtcgccggtgtttccattcggtgatcatcactgaacacagaggactcaccatggagtttgggctgagctgggtttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcgaataagcactacgcagagtccgtgaagggccgattgaccatctccagagacaactcgaagaatacggttcttctacaaatgaacagcctgagagctgaggacacggctatt

SEQ ID NO: 786488 - DNA, 426 bp, Homo sapiens
  misc_feature: NA.52.50.E06.1.454.heavy.3.zerom50
acccaacaaccacatccctcctcagaagcccccagagcacaacgcctcaccatggactggacctggaggatcctctttttggtggcagcagccacaggtgcccagtcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacacacactattcacagaagttgcagggcagagtcaccatcaccagggacacatccgcgagcacagcctacatggaactgagcagcctgagatctgaagacacggctgtatattactgtgcgagagggaagtggggatatgtagatgcg

SEQ ID NO: 786489 - DNA, 416 bp, Homo sapiens
  misc_feature: NA.14.68.G02.1.454.heavy.3.zerom50
tgtacacctgtggttctcactcaccgatggtcgattgggtgtgagctggatccgtcagtccccagggaaggccctggagtggcttgcacacatgtattggaatgacgaaaatcgtacaggaaatctctgcagagcaggctcatcatctccagggacacatccaaaagccaggtggtccttaccatgaccaacatggaccctgtggacacagccacatattactgtgcacggatcgtttattattacggttcggggagctccaagcttgactactggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 786490 - DNA, 459 bp, Homo sapiens
  misc_feature: NA.49.51.E07.2.454.heavy.3.zerom50
ctttctgagagtcatggatctcatgtgcaagaaagtgaagcacctgtggttcttcctcctgctggtggcggctcccagatgggtcctgtcccagctgcagctacaggagtcgggcccaggactgctgaagccttcggagaccctgtccctcacctgcactgtctctggtggttccttcagtagtccttattactactggggctgggtccgccagcccccagggaagggcctggagtggattgcgaatatctactatagtgggagcacctactacaatccttccctcaagagtcgcgtcactgtgtccgtggacacgtccaagaataaagtctccctgaacctgaactctgtgaccgccgcagacacggctgtctattactgtgccagaacgcggaaatccctacacaatgatgcttttgatgtctggggccatgggacaatggtcaccgtctcttcacg

SEQ ID NO: 786491 - DNA, 467 bp, Homo sapiens
  misc_feature: NA.47.3.A03.1.454.heavy.3.zerom50
agagkagaaggggctcagagaggagccttagcccyggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaaaacctatagtggactctctgaagggccgattcaccatctccagagacaacgccaagaactctctgtttctgcaaatggacagcctgagagtcgaagacacggctgtgtattactgtgtgtctctgacgcctcggccgymygkcktcg

SEQ ID NO: 786492 - DNA, 478 bp, Homo sapiens
  misc_feature: NA.10.83.H06.1.454.heavy.3.zerom50
tcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtctgggggaggcttggttcagccagggcggtccctgagactctcttgtacagcctctggatttaggtttcgtgattatgctatgagctggttccggcaggctccagggaaggggctggagtgggtaggtttcattagaagcatagcctatggtggggcttcagaatccgccgcgtctgtgaaaggccgattcaccatctcaagagacgatcccaaaagcctcgcctacctggaaatggacagcctgaaaagcgacgacacaggcgtctattattgtgttagagggaccatcgcgatagcagttcctaggaggggg

SEQ ID NO: 786493 - DNA, 469 bp, Homo sapiens
  misc_feature: NA.19.15.B04.1.454.heavy.3.zerom50
tccgcggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccagggaagggctggagtgggtcggccgtattacaaggaaagctaacagttacagtacagaatacggcgcgtctgtgaaaggaaggttcaccatctcaagagatgattcaaagaactcactgtatctgcaaatgaacagcctagaaaaccgaggacacggccgtgtattattgtggtagacaaaagagtggatgtggtggtag

SEQ ID NO: 786494 - DNA, 358 bp, Homo sapiens
  misc_feature: NA.19.62.F07.1.454.heavy.3.zerom50
aagggaaggggctggagtggattggcgaagtctttcataatggggcaaccaactacaacccgtccctcaggagtcgagtcaccatctcagtagacaagtccgagaaccagttctccctgaccctgaactctgtgaccgccgcggacacggccgtgtattactgtgcgagagagcgtcgcgattacagtcctggtgctggagaacctcttgactattggggccagggaaccctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 786495 - DNA, 475 bp, Homo sapiens
  misc_feature: NA.16.2.A02.1.454.heavy.3.zerom50
agggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaaggggctggagtgggtcgcatccattagtggtggtaataattacatatactacggagactcaatgaagggccgcttcaccatctccagagacaacgccgaaaactcactgtatctgcagatgaacagcctgagagccgaagacacggctgtgtattactgtgcgagaggtcttactatagttcggggagttaatataacgacgtatttcgtac

SEQ ID NO: 786496 - DNA, 495 bp, Homo sapiens
  misc_feature: NA.51.3.A03.2.454.heavy.3.zerom50
aggggtctcagagaggtgccttagccctggattccaaggcatttccacttggtgatcagcactgaacatagaggactcaccatggagttgggactgtgctgggttttccttgttgctattttagaaggtgtccagtgtgaggtgcggctggtggagtctgggggaggcttggtacagcctggggggtccctgacactctcctgtgcagcctctggattccccttcagaacttatgaaatgaactgggtccgacaggctccagggaaggggctgggagtggggtttcacacatttagtagtggtggaagtaccatattctacgcagactttgtgcagggccgattcaccatctccagagacgacgccaagaattcactgtatctagaaatgaacagcctgagagccgacgacacggctgtttattactgtgcgaggagtattacttatactatagttagtttsggttttttmccctttacttaccttccggtagtc

SEQ ID NO: 786497 - DNA, 481 bp, Homo sapiens
  misc_feature: NA.53.58.F03.1.454.heavy.3.zerom50
aagggaaaggggatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggagaccctgtccctcacctgcactgtctctgttggctccatcattcattatttctggagctgggtccggcagcccccagggaagggactggagtggattgggtatgtctattacaccgggaccacccactacaacccctccctcaagagtcgagtcaccatatcagtagacacgtccaggaaccagttctccctgaagctgagctctgcgaccgctgcggacacggccgtgtattattgtgcgagagttagatttgatactggtgcagccgtacgggggtcctggttcgaccccgtggggccatggaaccctggtcaccgtctcctcagt

SEQ ID NO: 786498 - DNA, 466 bp, Homo sapiens
  misc_feature: NA.53.43.D10.1.454.heavy.3.zerom50
aggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcctgtgcagcctctggattcgccttcagtaattttgcaatgtactgggtccgccagactccaggcagggggctagactgggtggcatttgtttcatatgatggaaccattaaatactacgcagactccgtgaagggccgaatcaccatctccagagacaattccaagaacacgttgtatttgtcaatgaacaacgtgagacctgaggacacggctgtgtattactgtgcgagagatcgtctaagggtggttcatgatgcttttgatt

SEQ ID NO: 786499 - DNA, 448 bp, Homo sapiens
  misc_feature: NA.51.61.F06.1.454.heavy.3.zerom50
acagtgagtctccctcactgcccagctgggatctcagggcttcattttctgtcctccaccatcatggggtcaaccgccatcctcgccctcctcctggctgttctccaaggagtctgtgccgaggagcagctggtgcagactggaacagaggtgaaaaagccgggggagtctctgaagatctcctgtaagggttctggacacagctttatcaactactggatcggctgggtgcgccagatgcccgggaaaggcctggagtggatgggcatcatctatcctggtgactctgatgtcagatacagcccgtccttccgcggccaggtcaccttctcagccgacaagtccatcgacaccgtctacctgcagtggagcagcctgaaggcctcggacaccgccatgtattactgtgcgagacagacaagagacggctacaatttggctttttacg

SEQ ID NO: 786500 - DNA, 457 bp, Homo sapiens
  misc_feature: NA.40.54.E10.1.454.heavy.3.zerom50
aacacacaaagggggctctgggagaggagccccagccctgagattcccaggtgcttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcatctttgatgcctatgccatgcactgggtccggcaagctccagggaagggcctggagtgggtctcaggtattagttggaatgggggtagcgtaggcgatgcggactttgtgaagggccgattcaccatctccagagacaacgccaagaactccctatatctgcaaatgaacagtctgagacctgaggacacggccctctattactgtgacaaaagagataagctaa

SEQ ID NO: 786501 - DNA, 453 bp, Homo sapiens
  misc_feature: NA.53.37.D04.2.454.heavy.3.zerom50
ttgggtttggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgtttattattgtgttgagagaggamcccgatsgtaccs

SEQ ID NO: 786502 - DNA, 330 bp, Homo sapiens
  misc_feature: NA.41.26.C04.1.454.heavy.3.zerom50
aaargagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 786503 - DNA, 488 bp, Homo sapiens
  misc_feature: NA.11.12.B01.1.454.heavy.3.zerom50
ttggatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggacccg

SEQ ID NO: 786504 - DNA, 470 bp, Homo sapiens
  misc_feature: NA.21.45.E01.1.454.heavy.3.zerom50
ctttcagagagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttctggggctgggtccggcagtccccagagaagggtctggagtggattgggagtgtctataatacggggagtcaatatcgtggtgacactccctactacaacccgtcttttaagagtcgagtcactatatcagtgcgctcgtccacgaaccaggtctccctgaggatgagatctgtgacggccgcagacacggccaagtatttctgtgcgagagaccccggagttagcgacgcctggaggcacgtggtacttcgatgcctggggccgtggcgcccgtggt

SEQ ID NO: 786505 - DNA, 471 bp, Homo sapiens
  misc_feature: NA.51.68.G02.3.454.heavy.3.zerom50
ctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcactgtctctggtggctccatcagcagcagtagttacttctggggctggatccgccagcccccagggaagggactggagtggatagggaatgtccattatagtgggagcacctactacaatccgtccctcaacagtcgagtcaccatatccgttgacacgtccaagaaccaattcttcctgaggctgacctctgtgaccgccgcagatacggcagtttattactgtgcaagaaagaactacctkraaactggggccacggaaccctggtcaccgtctcctcagcctccaccaagggcccatcggtctttcccccg

SEQ ID NO: 786506 - DNA, 460 bp, Homo sapiens
  misc_feature: NA.51.68.G02.4.454.heavy.3.zerom50
agcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctggggtcaccatgaccagcgacacatctagcaacacagtctacatggagttgaccagcctgaccgacacggccgtgtatttttgtgttggagagtagttttcgggactaaatccaagacgtaccccgtgtcggttcggcgaacg

SEQ ID NO: 786507 - DNA, 449 bp, Homo sapiens
  misc_feature: NA.52.56.F01.1.454.heavy.3.zerom50
aacacacaaaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaagtccctgagactctcttgtgcagcctctggattcaccttcagtagttatgttatgcaatgggtccgccaggctccaggcaaggggctggagtgggtggcacttatatcaggtgatggaggcaataaatattacacagactccgtgaagggccgattcaccatctccagagacaattccaagaacacgctgaatctgcaaatgaacagcctgagagttgaggacacggctgtmtatttctgtgcgagagatcgtctt

SEQ ID NO: 786508 - DNA, 517 bp, Homo sapiens
  misc_feature: NA.52.56.F01.2.454.heavy.3.zerom50
aacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacaggaagttccagggcagagtcaccatgaccgcggacacatccacgaacacagcctacatggagctgaggagcctaagatctgacgacacggccgtttattactgtgtgagagattttagggacctccgggcccgttggggggagtttaagtcgttacttttggacttacgtgggggccaggggaaccccaggtccacccggtctcccg

SEQ ID NO: 786509 - DNA, 499 bp, Homo sapiens
  misc_feature: NA.48.10.A10.1.454.heavy.3.zerom50
aggggactctgggagaggagccccagccctgagattcccaggtgtttccattcagcgatcagcactgaacacagaggactcaccatggacttgggactgagctggattttccttttggctcttttaaaaggtgcccagtgtgaagtacaactggtggagtctgggggaggcttggtgcagcctggcaggtccctgagactctcctgtgcagcctccggattcacctttgagaattttgccatgaactgggtccggcgacttccagagaagggcctggagtgggtcgcaatgattagtcgaagcaccaaaagtgtaggatatggggactctgtaaagggccgattcaccgtgtccagagacaacgccaaaattccctgtttcttgaaatgaacagtctgagacctgaggacacggccctatatttttgtactaaaagaccggagcagtggggggaatgggtggcagctcctcgggcttttgatttcgtttggggccgaac

SEQ ID NO: 786510 - DNA, 471 bp, Homo sapiens
  misc_feature: NA.48.10.A10.2.454.heavy.3.zerom50
aggggagctctgggagaggagctccagccttgggattcccagctgtctccactcggtgatcggcactgaatacaggagactcaccatggagtttgggctgaactgggttttccttgttgctattttaaaaggtgtccagtgtgaggtgcagctggtggagtccgggggagccttggttcagcctggggggtctctgaaactctcctgtgcagcctctgggttcatgttcaatgtctctgctattcactgggtccgccaggcttccgggaaagggctggaatgggttggtcgtattagaactaaagtaaatagttacgcgacagcagatgctgcgtcggtgaaaggcaggttcaccatctccagagatgattcaaagaacacggcgtatctgcaaatgaacagcctgaaaaccgaggacacggccattttatttttgtgctagatctgaagaattaccagctgctgtgttct

SEQ ID NO: 786511 - DNA, 460 bp, Homo sapiens
  misc_feature: NA.53.16.B05.1.454.heavy.3.zerom50
aaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggttcagctggtgcagtctgggggaggcgtagtccagcctgggaggtccctgagactctcctgtgtagcctctggattcacccccagaaactctgccatgcactgggtccggcaggctccaggcaaggggctggagtgggtgtccagtatatcgtatgatggtgacagtgaatactacgcagcctccgtgaggggccgattcaccgtctccagagacaattccaagaacacggtgtatctgcaaatgaagggcctgagacctgaggacacggcaacatactactgtgcgaatgacgtggatgtcgtggctacgccttta

SEQ ID NO: 786512 - DNA, 485 bp, Homo sapiens
  misc_feature: NA.14.9.A09.1.454.heavy.3.zerom50
agggggagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggaggcttggtccagcctggagggtccctgacactctcctgtgcagcctctggattcaccctcagtgaccgttacatggactgggtccgccaggctccagggaaggggctggagtgggttggccgtattagaaacaaagttaacagtgacaccacagaatacgccgcgtctgtgaaaggcagattcaccatctcaagagatgattcaaagaactcactgtttctgcaaatgaacagcctagaaaaccgaggacacggccgtgtattactgttsgtttccctaggatattgtggtggtggtcgctgcttcgactacgatatgwaac

SEQ ID NO: 786513 - DNA, 476 bp, Homo sapiens
  misc_feature: NA.14.9.A09.2.454.heavy.3.zerom50
agggggggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaacgaccgaggacacgagaccatctattactgtgctagagagtattgcagtcctacgacctgctagtgggggtccg

SEQ ID NO: 786514 - DNA, 491 bp, Homo sapiens
  misc_feature: NA.52.16.B05.1.454.heavy.3.zerom50
agggtagagctcacgtaagggggctctgggagacgagcccagcactggaagtcgccggtgtttccattcggtgatcatcagtgaacacagaggactcaccatggagtttgggctgacctgggttttcctcgttgctcttttaagagatgtccagtgtcaggtgcacctggtggagtctgggggaggcgtggtccagcctgggaagtccctgagactctcctgtagagactctggaatctacttcagtacttatggtctacattgggtccgccaggctccgggcaagggcctggagtgggtggcggtagtcacatatgaaagaaacaaaaagtactacgcagactccgtgaagggccgattcaccatctccagagacaactccaagaacacggtctatctacaaatgaatagcctcgtaactgcggacacggctgtttactactgtgcgacaggggccccgtcamtatcaggaggactcctactacttttcg

SEQ ID NO: 786515 - DNA, 479 bp, Homo sapiens
  misc_feature: NA.52.24.C02.1.454.heavy.3.zerom50
tagggaaaggggctctgagagaggagccttagccctggattccaaggcctatccacttggtgatcagcactgagcaccgaggattcaccatggaattggggctccgctgggttttccttgttgctattttagaaggtgtccagtgtgaggtgcagctggtggagtctgggggaggcctggtcaagccgggggggtccctgagactctcctgtgcagcctctggattcaccttcagcagttatagcatgaactgggtccgccaggctccagggaaggggctggagtgggtctcatttattagtactagttacttatactacgcagactcagtgaagggccgattcaccatctccagagacaacgccaggaattcactatatttgcaaatgaacagcctgcgagccgaggacacggctgtgtattactgtgcgcgagaacacagcaatggccatttcgactacgtggggaccgggaaccct

SEQ ID NO: 786516 - DNA, 472 bp, Homo sapiens
  misc_feature: NA.52.24.C02.2.454.heavy.3.zerom50
tagggaaaggggctgggagacgagcccagcactggaaggcgccggtgtttccattcggtgatcagcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagcaactatgcaatgcactgggtccgcctggctcccggcaagggtctggactgggtggcaggtatatcagatgatgggaccaaaaatactacgcaaactccgtgaagggccgattcaccgtatctagagacagttccgatgacacaatctatctgcaaatgaacagcctagaaagttgacgacacgggtcttttttactgttgcgcctgggagcagtggctggccacatgatgtcttttga

SEQ ID NO: 786517 - DNA, 479 bp, Homo sapiens
  misc_feature: NA.51.84.H07.1.454.heavy.3.zerom50
agctctgagagaggagcccagccctgggattttcaggtgttttcatgtggtgatcaggactgaacagagagaactcaccatggagtctgggctgacgtggctttttcttgtggctattttaaaaggtgtccagtgtgacgtgcagctggtggagtctgggggaggcttggtacagccgggggggtccctgagactctcctgtacagcctctggcttcacctttagagtctatgacatgagttgggtccgccaggctccggggaaggggctggagtgggtctcaacgatcagtgatagtggaagtaccacaaactacgccgactccgtgaagggccggtgcaccatctccagagacaattcgaaggacactttatatctacaaatcaacaggctgacaaccgcggacacggccgtctattactgtgcgaaagaagacggaccgctggacgaggagccagaggagaatcacttactttacg

SEQ ID NO: 786518 - DNA, 451 bp, Homo sapiens
  misc_feature: NA.51.84.H07.2.454.heavy.3.zerom50
ctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactaccaaaaacacgctgtatctaccaaatgaacagcctcagatctgaggacacggctatctactactgtgtrraagaatttgggtttcagtggcttac

SEQ ID NO: 786519 - DNA, 467 bp, Homo sapiens
  misc_feature: NA.11.40.D07.1.454.heavy.3.zerom50
ttaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcactgggtccgccaggctccaggcaagggactggagtggctatcatttatgtcatttgatggaactaatatatactattctggggccgttaagggtcgattcaccatctccagagacaattccaggaacacgctgtatctgcaattacacagcccgacaactgacgacacggctgtttattactgtgccacagatatacgcgaatttagcagggggtggccagtacagtcatacatttgccaactggggccagggaaccctggtcatcgtctcctcagcctccaaccg

SEQ ID NO: 786520 - DNA, 309 bp, Homo sapiens
  misc_feature: NA.40.36.D03.2.454.heavy.3.zerom50
atctctcttggggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 786521 - DNA, 474 bp, Homo sapiens
  misc_feature: NA.40.36.D03.1.454.heavy.3.zerom50
atctctcttgggggggagaggagccccagccttggaattcccaagtgttttcattcagtgatcaggactgaacacagaggactcaccatggagtttgggctgagctggattttccttgctgctattttaaaaggtgtccagtgtgaggtgcagctggtgcagtccggggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcaggggctcggttacctccgatactgacttac

SEQ ID NO: 786522 - DNA, 499 bp, Homo sapiens
  misc_feature: NA.7.21.B10.1.454.heavy.3.zerom50
aggagagagggggagctckgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgttacgaagggaggggggaaccgaggcgggagttccgaagtactcctttgacgtctgggcctac

SEQ ID NO: 786523 - DNA, 469 bp, Homo sapiens
  misc_feature: NA.53.5.A05.1.454.heavy.3.zerom50
aggggrskskgggagaggagcccagcactagaagtcggcggtgtttccattcggtgatcaccactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcaattatatcatatgatggaagtaagaagtactatgcagacttcctggagggccgattcaccatctccagagacaattccaagaacacgcagtatctccaaatgcacggcctgagagctgacgacacggctgtgtattactgtgcgaaagatcaaggttcggggataccgaaattttaggtaaa

SEQ ID NO: 786524 - DNA, 350 bp, Homo sapiens
  misc_feature: NA.40.66.F11.1.454.heavy.3.zerom50
agggaaaggggctggagtgggttggccgtgttaagaccaaacctgagggtggggcaatagactacgctgcacccgtgacaggcagattcgccatctcaagagatgattcagcaggcacggtgtatctggaaatgaacagcctgaaagccgaggacacagccgtgtattattgtaccgcagggctcggctactccgatactgactattggggccagggaaccctggtcaccgtctcctcagcctccaccaagggcccatcggtcttccccctggcgccctgctccaggagcacctccgagagcacagccggccctgggctgcctggtcaaggactacttccagtcgctaga

SEQ ID NO: 786525 - DNA, 313 bp, Homo sapiens
  misc_feature: NA.3.66.F11.1.454.heavy.3.zerom50
aggggctggagtgggtcgcaattacttatgacggtcgttacatacactacgcagactccgtgaggggcagattcaccatctccagagacaattccatgaacacggtctatcttcaaatgaacagcctgagagtcgaggacacggctgtatattattgtgtccactaccaattgggacagggaaccctggtcaccgtctcctcagcctccaccaagggcccatcggtcttccccctggcgccctgttccaggagcacctccgagagcacagcggccctgggctgcctggtcaaggactacttccgagtgcgtct

SEQ ID NO: 786526 - DNA, 359 bp, Homo sapiens
  misc_feature: NA.2.30.C08.1.454.heavy.3.zerom50
aagggaaaggggctggagtgggtctcaagtattagtggtagtggcgttagcatgtactacgcagactccgtgaagggccggttcaccatatccagagacacttccaagaacacgctgcatctgcaaatgaacagtctgagagccgaggacacggccgtgtattactgtgcgaaagaatgggggacgaggcgaagaataggcgatgcttttgacttctggggccaagggacaaaggtcaccgtctcttcagcctccaccaagggcccatcggtcttccccctggcaccctcctccaagagcacctctgggggcacagcggccctgggctgcctggtcaaggactacttcctgtcgagcgt

SEQ ID NO: 786527 - DNA, 445 bp, Homo sapiens
  misc_feature: NA.14.13.B02.1.454.heavy.3.zerom50
ttgggggaggcttggtccagcctggggggtccctgagactctcctgtgcagcctctggattcacctttagtaaatattggatgatgtgggtccgccaggctccagggaaggggctggagtgggtggcccacataaacgaagacggaattaagaaatactatctggactctgtgaagggccgattcaccatctccagagacaacgccgagaactcactgtatctgcagatgaacagcctgagagccgaagacacggccgtgtattactgtacgagagacgttgggtttaaaacttttgactattggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 786528 - DNA, 461 bp, Homo sapiens
  misc_feature: NA.9.76.G10.1.454.heavy.3.zerom50
aggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggaggcgtggtccagcctgggaagtccctgagactctcctgtgcagcctctggattcaccttcagtaaccatggcctgcactgggtccgccaggctccaggcaggggactggagtgggtggcacttatatcatatgatggaattaaaaatactatgcagactccgtgaagggccgattcaccatctccagagacaactccaagaacacgctgtttctgcaaatgaacagcctgagagctgaggacacggctgtgtatttctgtgctcaagataggtgggacttcggattcttggagtggtccg

SEQ ID NO: 786529 - DNA, 453 bp, Homo sapiens
  misc_feature: NA.22.52.E08.1.454.heavy.3.zerom50
agagagaaaggggctgagagaggagcccagccctgggattttcaggtgttttcatttggtgatcaggactgaacagagagaagtcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagcaattatgccatgagctgggtccgccaggctccagggaaggggctggagtgggtctcagctgttagtggtggtgatggtggcacatactacgcagactccgtgaagggccggttcaccatctccagagacaattccaagaacaccctatatatgcaaatgaacagcctgagagccgaagacacggccgtatactactgtgcgaagggcgtgatagcagc

SEQ ID NO: 786530 - DNA, 457 bp, Homo sapiens
  misc_feature: NA.48.31.C09.1.454.heavy.3.zerom50
tctgagagaggagccttagccctggattccaaggcctatccacttggtgatcagcactgagcaccgaggattcaccatggaactggggctccgctgggttttccttgttgctattttagaaggtgtccagtgtgaagtacagctggtggagtctgggggaggcctggtcaagcctggggggtccctgagactctcctgtgcaacctctggattcacattcactagatataccatgaactgggtccgccaggctccagcgaaggggctggagtgggtctcctccataagtagtggcagttcttacttacattacgcagactcagtgaagggccgattcgccatctccagagacaacgccaacaactcactgtttctgcagatggacaacctgagaggcgaggacacggctgtatattactgtgtctccccatacatcgcagctcgtggcacggtaccg

SEQ ID NO: 786531 - DNA, 481 bp, Homo sapiens
  misc_feature: NA.13.59.F04.1.454.heavy.3.zerom50
tagggattggggggaagaggaagactgacggtcctgccacaggtggtgctgggcacggtggaatcctgctccccaccatggacatactttgttccacgctcctgctactgactgtcccgtcctgggtcttgtcccaggtcaccttgagggagtctggtcctgcgctggtaaaacccaaacaggccctcacagtgacctgcaccgtctctgggctttcactcaatagaagtacagtgtgtatgagttggattcgtcagtccccagggaaggccctggagtggcttgcacgcattgattgggatgatgatcaaaaatattacaacacatctatgaagaccaggctcaccatctccaaggacatcttcacgagccaagtggtccttagaatgaccaacttggaccctgtggacacaggcacctattattgtgcacatcaaagagatttctactacggtgtggacgtctggggccaagggksccg

SEQ ID NO: 786532 - DNA, 484 bp, Homo sapiens
  misc_feature: NA.14.65.F10.1.454.heavy.3.zerom50
aggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttkggggcgcgggactcctcttgagatctggggccagggggacaatcggtcaccgtctcttcagt

SEQ ID NO: 786533 - DNA, 466 bp, Homo sapiens
  misc_feature: NA.26.73.G07.1.454.heavy.3.zerom50
aggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggcctggggcctcagtgacggtttcctgcagggcctctgggtacacgatcactacccatgctatcaactgggtgcgacaggcccctggacaaggacttgagtggttgggatggatcaacaccaacactgggcacccgacgtatctccaggacctcacaggacggcttgtcttttccgtggacacttctgtcagcacggcatatctgcagatcagcagtctaaagcctgaggacactgccgtgtattattgtacgagagaacgttatgcctgtagtggtggtagttgctactttgactactggggccagggacg

SEQ ID NO: 786534 - DNA, 356 bp, Homo sapiens
  misc_feature: NA.51.58.F03.2.454.heavy.3.zerom50
aagggaaaggggctggagtggatcggagaaatccaccatagtggaaacaccaactacagcccgtccctcaagagtcgaatcaccttatcagtagacacggccaagaaccagttctccctgaggctgacttctgttaccgccgcggacacggctgtttattactgtgcgagagctttgccaagttcgtctcgttttgacccatactttgactcctggggccaaggaacgctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 786535 - DNA, 468 bp, Homo sapiens
  misc_feature: NA.51.58.F03.3.454.heavy.3.zerom50
aagggaaaggggctgggagacgagcccagcactcgaagtcgccggtgtttccattcggtgatcatcactgaacacagaggactcaccatggagtttgggctgagctgggttttcctcgttgctcttttaagaggtgtccagtgtcaggtgcggctggtggagtctgggggaggcgtggtccagcctggggattccctgagaatctcctgtgcagcctctggattcaacttcaatagacatcctatgcactgggtccgccaggctccagacaaggggctggaatgggtggcagttatttcgtccactggaaacagtaaacattatggacgctccgtgaagggcccattcgccatctccagagacaattccaaaaataccctctatctgcgaatgaacagcctgcgacctgaagacacggctatatatttctgtgcgagaggggagtcttattgtaatgatggttcctgt

SEQ ID NO: 786536 - DNA, 483 bp, Homo sapiens
  misc_feature: NA.51.58.F03.4.454.heavy.3.zerom50
aagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccggggacaaagtcacgttgaccgcggacacagtcacggacacagcctacatggaactcaacggcctcagatttgaggacacggccgtctattattgtgcgagagtgagaaattacgggtggctactcccttgacctactggggccaggggaaccctggtacc

SEQ ID NO: 786537 - DNA, 354 bp, Homo sapiens
  misc_feature: NA.14.79.H02.1.454.heavy.3.zerom50
agggaaggggctggagtgggtggccaacatatttcagcatacaaatgagatgttctttgcggactctgtgaggggccgattcaccatctccagagacaacgccaagaactcagtgtatctgcaaatgaacagcctgagagtcgaggacacggctgtctactactgtgcgagagattgtagtagtgacggctgccatacgtctcttgacttctggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 786538 - DNA, 458 bp, Homo sapiens
  misc_feature: NA.10.75.G09.1.454.heavy.3.zerom50
agggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttggttcccccccacaggagtctgtgccgaggtgcagctggtgcagtcaggagcagaggtaaagaggcccggggagtctctgaagatctcctgtaaggcctctggattcatgtttagccactcctggatcggctgggtgcgccagatgcccgggaaaggcctggagtggatggggatcatctggcctagtgactctgatatcagatacagtccgtccttccaaggccaggtcaccatctcagccgacaagtccatcagcaccgcctatctgcagtggagtagccgta

SEQ ID NO: 786539 - DNA, 451 bp, Homo sapiens
  misc_feature: NA.3.75.G09.1.454.heavy.3.zerom50
aagggggacactgagtgtgagtgaacatgagtgagcaaaactggatttgtgtgccattttctgataacggtgtccttctgtttgcaggtgtccagtgtcaggtgcagctggtgcagtcggggggaggcgtggtccagcctgggaggtccctgagactctcctgtgcagcctctggcttcatcttcagtagctataaaatgcactgggtccgccaggctccaggcaaggggctggagtgggtggcacttatttcatatgatggaaggaacagatacttcgcagactccgtgaagggccgagtcaccatctccagagacaattccaagaacacggtgtctctgcaagtgaatagcctgagacgtgacgacacggctgtgtattactgtgcgagagagggtttcgcagctcgtccggcgggcccagttgaacatgactatcactactaccgtcg

SEQ ID NO: 786540 - DNA, 305 bp, Homo sapiens
  misc_feature: NA.40.41.D08.2.454.heavy.3.zerom50
agcaccaactacaacccctccctcaagagtcgagtcaccatatcagtagacacgtccaagaaccagttctccctgaagctgagctctgtgaccgctgcggacacggccgtgtattactgtgcgagagggctgggattactatggttcggggagttattagtctggggccagggaaccctggtcaccgtctcctcagcttccaccaagggcccatcggtcttccccctggcgccctgctccaggagcacctctgggggcacagcggccctgggctgcctggtcaaggactacttccagtcgctaga

SEQ ID NO: 786541 - DNA, 494 bp, Homo sapiens
  misc_feature: NA.43.29.C07.1.454.heavy.3.zerom50
agggaaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagtccccagggaaggggctggagtggattggggaagtcaatcacaggggaagtaccaactacaacccgtccctcaagagtcgagtcaacatagcagtagacacgtccaagaaccagttctccctgaagttgagttctgtgaccgtcgcggacacggctgtgtattattgtgcgagcagtggctggtaccgtggctactggggccagggaaccctggtcaccgtctcctcagcttccaccaagggcccatcggtccttcccctcggccgccctgccg

SEQ ID NO: 786542 - DNA, 340 bp, Homo sapiens
  misc_feature: NA.13.70.G04.1.454.heavy.3.zerom50
actagagtgggtctcagatattagtggtagtggtggtagcacatctcatgtagactccgtgaagggccggttcaccatctccagaggacaattccaagaacacgatgattctgcaaatgaacagcctgagagtcgaggactcggccctttattactgtgtgaaaagaactaccatgacgcgcgggccttttgactactggggccagggaattctggtcaccgtctcctcagcctccaccaagggcccatccgtcttccccctggcgccctgctccaggagcacctccgagagcacagcggccctgggctgcctggtcaaggactacttcctagtacgtga

SEQ ID NO: 786543 - DNA, 483 bp, Homo sapiens
  misc_feature: NA.53.49.E05.1.454.heavy.3.zerom50
aacacacaaagggggctctgggagaggagcccagcactagaagtcggcggtgtttccattcggtgatcagcactgaacacagaggactcaccatggagtttgggctgaactgggttttcctcgttgctcttttaagaggtgtccagtgtcaggtacaactggtggagtctgggggaggcgtggtccagcctgggaggtccctgagactctcctgtgcagcctctggattccccttccatgtatttgccatgcattgggtccgccaggctccaggcaaggggctggagtgggtggcagttatatcctttgatggaagtaacaaatattatggagagtccatgaagggccgattcaccatctccagagacaattccaagaacatagtgtatctgcaaatgaacggcctgagaggtgacgacacggctgtgtattactgtgcgaaagataatcccccgcctgagtacttttggtagaagactacga

SEQ ID NO: 786544 - DNA, 450 bp, Homo sapiens
  misc_feature: NA.53.49.E05.2.454.heavy.3.zerom50
aacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacgtccatcagcacagcctacatggagctacacggcctcgagatctgacgacacggccctgttatttttgtgtcgagagagtctattaaagtggactt

SEQ ID NO: 786545 - DNA, 465 bp, Homo sapiens
  misc_feature: NA.51.55.E11.1.454.heavy.3.zerom50
ttgggtttggggacccaaaaaccacacccctccttgggagaatcccctagatcacagctcctcaccatggactggacctggagcatccttttcttggtggcagcagcaacaggtgcccactcccaggttcagctggtacagtctggagctgaagtgaagaagcctggggcctcagtgaaggtctcctgcaaggcctctggttacacctttatgaattatggtatcagctgggtgcgccaggcccctggacaagggcttgagtggatgggatggatcagcgcttacactggtgacacaaagtatgcacagaaactccagggcagagtcaccatgaccacagacacgtccacgagcacagcctacatggaactgaggagcctgggatctgacgacacggccgtgtattactgtgcgagagataggccccgaggggagaggtagttggttttcgaccgtctggcagtt

SEQ ID NO: 786546 - DNA, 480 bp, Homo sapiens
  misc_feature: NA.49.13.B02.2.454.heavy.3.zerom50
tccgcgggggggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgtagtatgcacattacggct

SEQ ID NO: 786547 - DNA, 493 bp, Homo sapiens
  misc_feature: NA.49.13.B02.3.454.heavy.3.zerom50
tccgcgggcacgaccggtgctcgatttagtcgagctctccgcggggagctctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgaggggccgattcaccatctccagagacaacgccaagaactcactgtatctccaaatgaacagcctgagagtcgaggacacggctgtctattactgtgcgagagatcccaacagcggtcg

SEQ ID NO: 786548 - DNA, 509 bp, Homo sapiens
  misc_feature: NA.52.49.E05.1.454.heavy.3.zerom50
aacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagattttagggacctcggcccttgggggagttagtcgtttactttgactacgtgggggccaggggaacccaggtccaccgtctccgtcccg

SEQ ID NO: 786549 - DNA, 464 bp, Homo sapiens
  misc_feature: NA.52.49.E05.2.454.heavy.3.zerom50
aacacacaaaggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctattcttttactgttgcgagagggaactcggattacagcacg

SEQ ID NO: 786550 - DNA, 491 bp, Homo sapiens
  misc_feature: NA.4.66.F11.1.454.heavy.3.zerom50
aagggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctgggggaggcttgataaagcctggggggtcccttagactctcctgtgcagcctctggattcaccttcagtgacgactggatgaattggatccgccaggctccagggaaggggctggagtgggtcggccatattaagcccaaaactgaacgtggggaaacagactacgctgcacccgtgagaggcagattcaccatttcaagagatgattcaaaaagtacactgtatctggaaatgaacagcctgagaatcgacgacacagccgtttattactgcagaagagggcactatggtccctggggccagggaaccctggtcaccgtctcctcacgtccc

SEQ ID NO: 786551 - DNA, 335 bp, Homo sapiens
  misc_feature: NA.13.5.A05.1.454.heavy.3.zerom50
agggggaggcattagacattacgcagactccgtgaagggccgattcacagtttccagagacaattccaagaatacggtgtttctgcaaatggacagcctgcggggcgacgacacggctaaatattactgtacgagagaccatttccatgactatggtgtctctcccggattttacaagggcatggacgtctggggccaagggactaccgttaccgtcgccgcagcctccaccaagggcccatcggtcttccccctggcgccctgctccaggagcacctccgagagcacagcggccctgggctgcctggtcaaggactacttcctagtacgtgacg

SEQ ID NO: 786552 - DNA, 465 bp, Homo sapiens
  misc_feature: NA.10.1.A01.1.454.heavy.3.zerom50
aggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcagctggcggagtctgggggaggcgtggtccagcctgggaggtccctgagactctcctgtgcagcctctgggttcaccttcaatacctatggcatgcactgggtccgccaggctccaggcaaggggctggagtgggtggctcttatctcatatgatggaaatgttaaattttatgcagactccgtgaagggccgattcaccatctccagagacaattccaggaacaccctgtatctgcaaatgaacagcctgagagctgacgacacggctgtttattactgtgcgacagagcagctgacttaaacgcgaagctcgtaaaccg

SEQ ID NO: 786553 - DNA, 474 bp, Homo sapiens
  misc_feature: NA.51.13.B02.1.454.heavy.3.zerom50
tccgcggggacccaaaaaccacacccctccttgggagaatcccctagatcacagctcctcaccatggactggccctggaacatccttttcttggtggcagcagcaacaggtgcccactccgaggctcagctggtgcagtctggacctgaggtgcagaagcctggggcctcagtgaaagtctcctgcagggcctctgatttcaccttttccaactatggtttcgcttgggtgcgacaggcccctggacagggcctggagtggctgggatggatcagcactgacagactgaatattaattatgcacagggtctccagggcagagtcaccgtgtccgcagacacgtccacgggcacggcctatatggaattgaggagcctcagatatgacgacacggccgtgtattactgtgccagaggggccgtttgggggagttagtggtccctgtgtctttggatggtctggggccaagggact

SEQ ID NO: 786554 - DNA, 613 bp, Homo sapiens
  misc_feature: NA.51.42.D09.2.454.heavy.3.zerom50
agggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaggtggtggagtcggggggaggcgtggtccagcctgggaggtccctgagactctcctgtgcagcctctaaattcagtttcagtagatttggcgtgcactgggtccgccaggctccagggmaaggggctggagtgggtggcagttatatcatatgatggaaagaataaatactatggagactccgtgaagggccgattcaccatctctagagacaatctcaaggagacagtgcatctgcaaatgaacagcctgagaggtgaygacacggctgtgtattactgtcacctcgagagcagcaattggagtagaggtttttgatatctggggccaagggactatggtcaccgtctcttcagcctccaccaagggcccatcggtcttccccctggcaccctcctccaagagcacctctgggggcacagcggccctgggctgcctggtcaaggactacttcctcgtagcact

SEQ ID NO: 786555 - DNA, 358 bp, Homo sapiens
  misc_feature: NA.49.61.F06.1.454.heavy.3.zerom50
ctctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 786556 - DNA, 426 bp, Homo sapiens
  misc_feature: NA.4.9.A09.2.454.heavy.3.zerom50
agggggattcacttttaccaaccatgccatgagctgggtccgccaggctccagggaaggggctggagtgggtctcaggcattagtggaattggtcgtgccacatactacgcagactccgtgaagggccgattcaccatctccagagacaattccaagaacacagtgtatctgcaaatgaacagcctgagagccgaggacacggccgtatattattgtgcgaacctaggaacgtcctattacgagattatgactggtcacggtgtcggtggctactttgacttctggggccagggaactatggtcaccgtctcgtcagcctccaccaagggcccatcggtcttccccctggcaccctcctccaagagcacctctgggggcacagcggccctgggctgcctggtcaaggactacttccctacagtgct

SEQ ID NO: 786557 - DNA, 460 bp, Homo sapiens
  misc_feature: NA.47.45.E01.1.454.heavy.3.zerom50
actctcagagaggtgccttagccctggattccaaggcatttccacttggtgatcaacactgaacacagaggactcaccatggagttggggctgtgctgggttttccttgttgctattttagaaggtgtccagtgtgaggtgcaactggtggagtctgggggaggcttggtacagcctggtgggtccctgagactctcctgtgtagcctctggattcaccttcagttattatagtatgaactgggtccgccaggctccagggaaggggctggagtgggtttcatacattagtagtgacactagtgttagtcctggtagtacaatttactacgcagactctgtgaagggccgattcaccatctccagagacgatgccaggacctcactgtatctgcaaatgaacagcctgagagacgaagacacggctgtgtattactgtgcgagagaacgtggatactaag

SEQ ID NO: 786558 - DNA, 444 bp, Homo sapiens
  misc_feature: NA.51.25.C03.1.454.heavy.3.zerom50
aaatactttctgagagtccaggacctcctgtgcaagaacatgaaacacctgtggttcttcctcctgctggtggcagctcccagatgggtcctgtcccagctgcagctacaggagtccggctcaggactggtgaagccttcacagaccctgtccctcacctgcgctgtctctggtggctccatcggcagtgctgattactcctggagctggatccggcagtcaccagggaagggcctggagtggattgggtatatctatgatagtgggagcgcctactacaacccgtccctcaagaggcgagtcaccatatctctagacaggtccaagaaacagttctccctgaagctgagctctgtgaccgccgcggacacggccgtctattactgtgccagacgagttgtcgtagtcccagctgatgtcgatttattattactattatgctat

SEQ ID NO: 786559 - DNA, 367 bp, Homo sapiens
  misc_feature: NA.13.30.C08.2.454.heavy.3.zerom50
aagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttccccctggcaccctcctccaagagcacctctgggggcacagcggccctgggctgcctggtcaaggactacttcctagtacgtgacg

SEQ ID NO: 786560 - DNA, 635 bp, Homo sapiens
  misc_feature: NA.49.44.D11.1.454.heavy.3.zerom50
agggaaaggggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtmkggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagyctgagagctgaggacacggctatgttttactgtgcgagagggaactcgattacagcagccctcgaagaacatcatgatggctttgatatctggggccaagggacaatggtcattgtctcttcagcctccaccaagggcccatcgtcttcccctggccacctcctccaagagcacctctcgggggcgacagcggccctcgggctcgcctggtcaagggtactacgttcctctcctccg

SEQ ID NO: 786561 - DNA, 620 bp, Homo sapiens
  misc_feature: NA.48.61.F06.1.454.heavy.3.zerom50
ctctgggagacgagcccagcactggaagtcgccggtgtttccattcggtgatcagcactgaacacagaggactcaccatggagtttgggctgacctgggttttcctcgttgctctttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggctgtgtattactgtgcgagaggctatcactatggttcggggacttttcagggaaactggctcgacccctggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 786562 - DNA, 359 bp, Homo sapiens
  misc_feature: NA.47.60.F05.2.454.heavy.3.zerom50
gggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttgggaccgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 786563 - DNA, 498 bp, Homo sapiens
  misc_feature: NA.22.34.D01.1.454.heavy.3.zerom50
ttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtccgatatctggccgttcgacccctggggccagggaaccctggtcaccgtctcctcagcctccaccaagggcccatcggtcttcccctggcgccctgctccaggagcacctccgagagcacagcggccctgggctgcctggtcaaggactacttccacg

SEQ ID NO: 786564 - DNA, 476 bp, Homo sapiens
  misc_feature: NA.53.41.D08.3.454.heavy.3.zerom50
aagactgacggtcctcccaggtgtccagtgtcacgtgcagctggtgcagtctgggggaggcgtggtccagcctgggaggtccctgaaactctcctgtgcagcctctggattcgtctcaagtgtctaccctatgcactgggtccgccaggctccaggcaaggggctggagtgggtggcacttatctcatctgatggaagagatgtctattacgcagactccgtgaagggccgattcaccatctccagagacaattccaagaacacactgtatctgcaaatggacagtctgagaactgaagacacggctgtgtattactgtgcgagtgagatgtcttactatgatgccagtggtttagtaccgttcgacccctggggccagggaaccctggtcaccgtctcctcagcttccaccaagggcccagtcggtccttccccctyggcgccctgyyccgwcgtmsgtccgtacggaggtaccg

SEQ ID NO: 786565 - DNA, 467 bp, Homo sapiens
  misc_feature: NA.51.33.C11.2.454.heavy.3.zerom50
ttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgaggagggaactcgattacagcacgcctacgg

SEQ ID NO: 786566 - DNA, 421 bp, Homo sapiens
  misc_feature: NA.4.6.A06.2.454.heavy.3.zerom50
agggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcaccaccgcctacctgcagtggagcagcctgaaggcctcggacaccgccatgtattactgtgcgagcgcctatagatatagcagcacctggtacatgtggcgtggtgcttttgatatctggggccaagggacaatggtcaccgtctcttcagcctccaccaagggcccatcggtcttccccctggcaccctcctccaagagcacctctgggggcacagcggccctgggctgcctggtcaaggactacttccctacagtgct

SEQ ID NO: 786567 - DNA, 617 bp, Homo sapiens
  misc_feature: NA.51.70.G04.2.454.heavy.3.zerom50
ctctgggagaggagcccagcactagaagtcggcggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgacccccgbcgctcggtgcggaggtctggggccaagggaccacggtcatcgtctcctcagcctccaccaagggcccatcggtcttccccctggcaccctcctccaagagcacctctggggcacagcggccctgggctgcctggtcaaggactacttcctcgtagcact

SEQ ID NO: 786568 - DNA, 499 bp, Homo sapiens
  misc_feature: NA.48.56.F01.1.454.heavy.3.zerom50
aacacacaaagggggctctgagagaagagcccagccctgggattttcaggtgttttcatttggtgatcaggactgaacagagagaactcaccatggagtttgggctgaggtggctttttcttgtggcgattttaagaggtgtccagtgtgaggtgaagttgttggagtctgggggaggcttggtaaagccggggggctccctgacactctcctgtgtaacctctggcttcgactttaagtcttatgccatgacctgggtccgccaggctccagggaaggggctggagtgggtctcaacaattagtgttagtggtgacgacagatactacgcagactccgtggagggccgcttcaccatctccagagacagccccaagaacacactgtctctggagatgatcaacctgagagccgacgacacggcagtgtattactgcgcgaaagaaatcaagtgggctcatctcgggcggccgacccacgtggggccacgggtaacccg

SEQ ID NO: 786569 - DNA, 389 bp, Homo sapiens
  misc_feature: NA.40.53.E09.2.454.heavy.3.zerom50
ttgggtttgggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttccccctggcgccctgctccaggagcacctctgggggcacagcggccctgggctgcctggtcaaggactacttccagtcgctaga

SEQ ID NO: 786570 - DNA, 474 bp, Homo sapiens
  misc_feature: NA.13.36.D03.1.454.heavy.3.zerom50
atctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtgaccgccgcggacacggctgtgtacttctgtgcgagaggcaatttttggactcgtcattctccctttgacttctggggccagggaaccctagtcaccgtccg

SEQ ID NO: 786571 - DNA, 622 bp, Homo sapiens
  misc_feature: NA.51.72.G06.1.454.heavy.3.zerom50
ctctgggagaggagcccagcactagaagtcggcggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtcgacccccgtccgctcggtgcggaggtctggggccaagggaccacggtcatcgtctcctcagcctccaccmagggcccatcggtcttccccctggcaccctcctccaagacgcacctctggggggcacagcggccctgggctgcctggtcaaggactacttcctcgtagcact

SEQ ID NO: 786572 - DNA, 452 bp, Homo sapiens
  misc_feature: NA.49.32.C10.2.454.heavy.3.zerom50
ctttctgagagtcatggatctcatgtgcaagaaagtgaagcacctgtggttcttcctcctgctggtggcggctcccagatgggtcctgtcccagctgcagctacaggagtcgggcccaggactgctgaagccttcggagaccctgtccctcacctgcactgtctctggtggttccttcagtagtccttattactactggggctgggtccgccagcccccagggaagggcctggagtggattgcgaatatctactatagtgggagcacctactacaatccttccctcaagagtcgcgtcactgtgtccgtggacacgtccaagaataaagtctccctgaacctgaactctgtgaccgccgcagacacggctgtctattactgtgccagaacgcggaaatccctacacaatgatgcttttgatgtcgtggggccagtgggacaatggtcaccgt

SEQ ID NO: 786573 - DNA, 486 bp, Homo sapiens
  misc_feature: NA.14.33.C11.1.454.heavy.3.zerom50
ttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcacgcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggacaaatatggttcaggggagttcgactacgtggggccagggaaccctggtcaccgtctcctcacgcctccaccgamggg

SEQ ID NO: 786574 - DNA, 448 bp, Homo sapiens
  misc_feature: NA.53.28.C06.2.454.heavy.3.zerom50
agacgagcccagcactggaagtcgccggtgtttccattcggtgatcatcactgaacacagaggactcaccatggagtttgggctgagctgggttttcctcgttgctcttttaagaggtgtccagtgtcaggttcagctggtgcagtctgggggaggcgtagtccagcctgggaggtccctgagactctcctgtgtagcctctggattcacccccagaaactctgccatgcactgggtccggcaggctccaggcaaggggctggagtgggtgtccagtatatcgtatgatggtgacagtgaatactacgcagcctccgtgaggggccgattcaccgtctccagagacaattccaagaacacggtgtatctgcaaatgaagggcctgagacctgaggacacggcaacatactactgtgcgaatgacgtggatgtcgtggctacgccttta

SEQ ID NO: 786575 - DNA, 468 bp, Homo sapiens
  misc_feature: NA.52.26.C04.1.454.heavy.3.zerom50
atgctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtgcctccatcagcggtcatggttacttctggggctggatccgccagcccccagggaaggggctggagtggattggaaatatctattatagtgggagcacctcctactacaacccgtccctcaggagtcgagtcactatatccgtagacacgtccaagaaccagttctccctgaagctgagctctgtgaccgccgcagacacggcttgtttattactgtgcgagacatctaagcaataatgtggatacacttatggagttgctattccgtggggsccaggggkaacccctgggtaccg

SEQ ID NO: 786576 - DNA, 458 bp, Homo sapiens
  misc_feature: NA.49.70.G04.4.454.heavy.3.zerom50
tgatcatcactgaacacagaggactcaccatggagtttgggctgagcgtgggttttcctcgttgctcttttaagaggtgtccagtgtcaggtgcttctggtggactctgggggaggcgtggtccggcctgggaggtccctgagactctcctgtgcagcctctcgagttcaccttcagtgtctatactatgcactgggtccgccaggctccaggcaaggggctggagtgggtggcacttatatcaaatgatggaagaattcaacactacgcaggctccgtgaagggccgatttcaccatctccagagacaattccaagaacacactgtctctgcaaatgaatagccctgagagttgaggacacggctcgtctattactgtgcgagagctaagggtacttactcatagtatttggactactggagccagggacgcccgtggtccaccgtcctcctcacgt

SEQ ID NO: 786577 - DNA, 468 bp, Homo sapiens
  misc_feature: NA.40.28.C06.1.454.heavy.3.zerom50
aagaggaagactgacggtcctgccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaacataagatattcacagaagtttcagttcagagtcacctttagcagcgacacatccgcgacgacagtctacatggagttgagtggcctaagatctgaagacacggctgtctattactgtgcgagagatgccttacacgacgagggggcccactttgattactggggccagggaaccctggtcaccgtctcctcagcctccaccaacgggcccatcggtccttccccctcggccgccctgctccaggagcacctccgacgg

SEQ ID NO: 786578 - DNA, 325 bp, Homo sapiens
  misc_feature: NA.11.20.B09.2.454.heavy.3.zerom50
agggactggagtggattggtcatatcgataccactggaaacaccaattacaacccctccctcaagagtcgagtcaccatatccctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 786579 - DNA, 460 bp, Homo sapiens
  misc_feature: NA.51.82.H05.1.454.heavy.3.zerom50
tctctgggagaggagcccagccctagaagtcggcggtgtttccattcggtgatcagcactgaacacagaggactcaccatggagtttgggctgagctgggttttcctcgttgctcttttaagaggtgtccagtgtcaagtgcaactggtggagtctgggggaggcgtggtccagcctgggaggtccctgagactctcctgcgtggcctctggattcaccttcaatagttatggcatgctctgggtccgccaggccccaggcagggggctggactgggtagcatctatatcgtacgatggagctgacgaatacctcgcagactccgtgaagggccgattcaccatctcaagagacaattccaagaacaccctgtttctgcaaatgaacagcctgagacctgcggacacggctatgtatttctgtgcgaaggttactgggacctactctggtcccgcacgka

SEQ ID NO: 786580 - DNA, 459 bp, Homo sapiens
  misc_feature: NA.51.82.H05.3.454.heavy.3.zerom50
cacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctwwtttctgtgcgagactgcccggtcctgcacctcgtgtggcccctaattttc

SEQ ID NO: 786581 - DNA, 467 bp, Homo sapiens
  misc_feature: NA.49.51.E07.1.454.heavy.3.zerom50
agaggagccccagcccggagattcccaggtgtttccattcggtgatcagcactgaacacagagaactcaccatggagtttggactgagctgggttttccttgttgccatgttaaaaggtgtccagtgtgaagtgcggctggtggagtctgggggaggcgtggtgcagcctggggggtccctcagactctcctgtgcagcctccaacttcagctttggtgattttaccatgcactgggtccgccaaggtccggggcggggtctggagtgggtcgctcttattagtggagatgaagatggcacctactatgcagattctgtgaagggccggttcaccatctccagagacaacaggaaaagtccctgtatctgcaaatgaacagtctgaggactgaggacaccgccttgtattattgtgtaaaggaaatacaaagagtcttacgattgtttggagtgcatattacgtacg

SEQ ID NO: 786582 - DNA, 482 bp, Homo sapiens
  misc_feature: NA.16.2.A02.2.454.heavy.3.zerom50
aggggagagagaggagccttagccctggattccaaggcctatccacttggtgatcagcactgaccaccgaggattcaccatggagctggggctccgctgggttttccttgttgctatttttagaaggtgtccagagtgaggtgcagctggtggagtttgggggaggcctggtcaagcctggggggtccctgagactctcctgtgcagcctctggattcacctttgacagctatgccatgacctgggtccgccaggctccagggaaggggctggaatgggtctcaggtattactggtggtggttataccacagtactacgcagactccgtgaagggccggttacaccatctccagagacaattccaagaacacactgtatctgcaaatgaacagcctgagagccgacgacacggccatatattactgttgcgaaagcaaccggcagttagttcacccatactactttgactactgggcctaac

SEQ ID NO: 786583 - DNA, 458 bp, Homo sapiens
  misc_feature: NA.53.58.F03.2.454.heavy.3.zerom50
aagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtcccccggactttacg

SEQ ID NO: 786584 - DNA, 567 bp, Homo sapiens
  misc_feature: NA.53.58.F03.3.454.heavy.3.zerom50
aagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggttttggactggttctcccatggaatccctactttgagtactgggccgcggagccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 786585 - DNA, 459 bp, Homo sapiens
  misc_feature: NA.53.37.D04.3.454.heavy.3.zerom50
ttgggtttggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagcacgggtgtatattactgtgcgagagggaaggtgggatatttgkagatgccgccagggtcscccggccggt

SEQ ID NO: 786586 - DNA, 344 bp, Homo sapiens
  misc_feature: NA.51.68.G02.1.454.heavy.3.zerom50
ctggagtggatcggagaaatccaccatagtggaaacaccaactacagcccgtccctcaagagtcgaatcaccttatcagtagacacggccaagaaccagttctccctgaggctgacttctgttaccgccgcggacacggctgtttattactgtgcgagagctttgccaagttcgtctcgttttgacccatactttgactcctggggccaaggaacgctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 786587 - DNA, 371 bp, Homo sapiens; identical to SEQ ID NO: 786294
  misc_feature: NA.51.68.G02.2.454.heavy.3.zerom50

SEQ ID NO: 786588 - DNA, 477 bp, Homo sapiens
  misc_feature: NA.48.10.A10.3.454.heavy.3.zerom50
agggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatgtccctttgtatattggtgggggtccgaacggggacaaagttggtcaccggtcttccg

SEQ ID NO: 786589 - DNA, 485 bp, Homo sapiens
  misc_feature: NA.11.40.D07.2.454.heavy.3.zerom50
taacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtrcagcctctggmttcaycttcawtacctwtggcatgcactgggtccgccagrctccaggcargggrctggagtggstrkcakttatktcatwtgatggaamtartrwmtwctattcwgrskccgtkaagggycgattcaccrtctccagagacaattccaggcacacgctgtatctgcaaatgaacagcctgagagctgaggacacggctgtgtattactgtgacgaaagatttctatagaggtgacgtacgggggcgttctttgactacgtggggccgagggaaccctggtccaccgtctccctcacgcctccaccgaagggccccagtccggtcttccccg

SEQ ID NO: 786590 - DNA, 488 bp, Homo sapiens
  misc_feature: NA.4.14.B03.2.454.heavy.3.zerom50
tccgcgggggagagaggagccttagccctggattccaaggcctatccacttggtgatcagcactgagcaccgaggattcaccatggaactggggctccgctgggttttccttgttgctctttttggaggtgtccagtgtgaggtacaactggtggactctgggggaggcctggtcaggcctggggggtccctgagactctcctgtgcagcctctggattcaccttcggaaactatcacatgaactgggtccgccaggctccagggaaggggctggagtgggtctcctgtattagtagtgccggcacttacacatactatgcagactcagtgaagggccgattcaccatctccagagacaacgccaagaactcactgtttcttcaaatggacagcctcagagtcgacgacacggctgtgtattactgtgcgagagcggttagtggtggttacgttccggggcaacgtggggccgaggggaaccctggtc

SEQ ID NO: 786591 - DNA, 473 bp, Homo sapiens
  misc_feature: NA.51.55.E11.2.454.heavy.3.zerom50
ttgggtttggggtctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggt

SEQ ID NO: 786592 - DNA, 332 bp, Homo sapiens
  misc_feature: NA.9.46.E02.1.454.heavy.3.zerom50
ctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaaggactacttccagacgtatca

SEQ ID NO: 786593 - DNA, 467 bp, Homo sapiens
  misc_feature: NA.21.85.H08.1.454.heavy.3.zerom50
tcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtctgggggagctgtggtacggcctggggggtccctgagactctcctgtgaagcctctggattcacctttgatgattatggcatggcctgggtccgccaagctccagggaaggggctggagtgggtctctggtataaattacaatggaggtcacacagcttatagagactctgtggaggggccgattcaccatctccagagacagcgccaagaacctccctgtatctgcaaatgaacagtctgagagccgaggacacggccttatattactgtgcgcgtgagtggggttgggtcgtccytttccg

SEQ ID NO: 786594 - DNA, 476 bp, Homo sapiens
  misc_feature: NA.3.23.C01.1.454.heavy.3.zerom50
caggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaacgggcccatcggtccttccccctcggccgtccccg

SEQ ID NO: 786595 - DNA, 464 bp, Homo sapiens
  misc_feature: NA.7.76.G10.1.454.heavy.3.zerom50
agggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtcgacccctgactgataaaccggactggttcgaccccgtggggccgagggaaccctggtcaccgtctcctccg

SEQ ID NO: 786596 - DNA, 456 bp, Homo sapiens
  misc_feature: NA.10.58.F03.1.454.heavy.3.zerom50
aagggaaaggggctgggagacgagcccagcactggaagtcgccggtgtttccattcggtgatcatcactgaacacagaggactcaccatggagtttgggctgacctgggttttcttcgttgctcttttaagaggtgtccagtgtcaggtgcagctggtggagtctgggggaggcgtggtccagcctgggaggtccctgagactctcctgtgcagcctctggattcaccttcaggacctatgcaatgcactgggttcgccaggctccaggcaaggggctggagtggctggcagttatatcatttgatggaagccataaatactacgcagactccgtgaagggccgattcaccatctccagagagaactccgagagcactctttatgtacaaatgaactacctgagagctgacgacacggctgtgtactactgtgcgagatcaggtkgggggggactc

SEQ ID NO: 786597 - DNA, 458 bp, Homo sapiens
  misc_feature: NA.4.75.G09.1.454.heavy.3.zerom50
agggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctacgtggggccagggaaccctggtcaccgtctcctcagcctccaccgac

SEQ ID NO: 786598 - DNA, 351 bp, Homo sapiens
  misc_feature: NA.12.41.D08.1.454.heavy.3.zerom50
ctggagtgggtctcaacgattacttctactggcgaaaagacgacattcgcagactccgtgaagggccggttcaccatctccagagacaactccaagagtaccttatcactgcagatgaacagtgtgagagccgaagacgcggccgtttacttctgtactaaacccagggccgtggagatggctacgtcaggaggacctttcgaccactggggccagggaaccctggtcaccgtctcctcagcctccaccaagggcccatcggtcttccccctggcaccctcctccaagagcacctctgggggcacagcggccctgggctgccctggtmaaggactacttcctacgtcgtat

SEQ ID NO: 786599 - DNA, 455 bp, Homo sapiens
  misc_feature: NA.43.9.A09.1.454.heavy.3.zerom50
agggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatgaaccctaacaatggtgccactctgtatgcacagaactttcaggacagggtcaccatgaccagggacacgtccatcaacacaggctacatggacctgagcagcctcagacctgacgacacgggcgtcctatttctgtgcgagagtccctatgttgggcccaactggggactttggtacg

SEQ ID NO: 786600 - DNA, 272 bp, Homo sapiens
  misc_feature: NA.11.59.F04.1.454.heavy.3.zerom50
tagggattggggctgggagaggagcccagcactagaagtcggcggtgtctccattcggtgatcagcactgaacacagaggactcaccatggagtttgggctgaactgggttttcctcgtagctcttttaagaagtgattcatggagaaatagagagactgagtcctccaccaagggcccatcggtcttccccctggcaccctcctccaagagcacctctgggggcacagcggccctgggctgcctggtcaaggactacttccgtatctctcg

SEQ ID NO: 786601 - DNA, 512 bp, Homo sapiens
  misc_feature: NA.40.56.F01.1.454.heavy.3.zerom50
aacacacaaaggggcaacacacaaagggggtgctttctgagagtcatggacctcctgcacaaaaacatgaaacacctgtggttcttcctcctcctggtggcagctcccagatgggtcctgtcccagccgcagctacagcagtggggcgcgggactgttgaagccttcggagaccctgtccctcacctgcgctgtcaatggtgagtcctttggtggttatcactggagctggatccgccagtctccccggaggggcctggagtggattggcgaaatcaatcatcgtgaaatcaccaactacaacccgtccctcaagagtcgaatcagtatttctgtagacacgtccaagaagcaattctccctgatgatgagttctctgaccgccgcggacacggctgtgtatttctgtgcgagccaacatgaaggcagtttgggggagttagtggtaccccttttgagttagtttgggggccgaggggasgtccgtgggtccaccggtctccktccctaccg

SEQ ID NO: 786602 - DNA, 421 bp, Homo sapiens
  misc_feature: NA.48.51.E07.1.454.heavy.3.zerom50
agcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtgtattattgtgcgagagcctcacgg

SEQ ID NO: 786603 - DNA, 480 bp, Homo sapiens
  misc_feature: NA.48.85.H08.1.454.heavy.3.zerom50
tcgcggggkmgcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgacggacacggccatttactactgtgcgcggggagtskggacggagcttcggttttcggagttatctatctacttactttgaatcgttc

SEQ ID NO: 786604 - DNA, 330 bp, Homo sapiens
  misc_feature: NA.3.1.A01.1.454.heavy.3.zerom50
catcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 786605 - DNA, 480 bp, Homo sapiens
  misc_feature: NA.8.82.H05.1.454.heavy.3.zerom50
acccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaagcccggggcctcagtgaaggtctcctgcaaggcgtccggttacagtttcacaacgtatggtattagttgggtgcgacaggcccctggacaagggcttgagtggatggggtggatcagcgccttcaactattacacaaactatgcacagaagttccgtgacagagtcaccatgaccatagacatttccacggacacagcctatatggagctgcggagcctgacatctgacgactcggccgtctatttctgtgcgagaagaaatggggatggtggggttggggccttattttgacttacgtggggccaggggaaccctggtcaccgtctcccg

SEQ ID NO: 786606 - DNA, 453 bp, Homo sapiens
  misc_feature: NA.5.31.C09.1.454.heavy.3.zerom50
ctctgggagaggagccccagccctgagattcccaggtgtttccattcggtgatcagcactgaacacagagaacgcaccatggagtttggactgacctgggttctccttgttgctattttaaaaggtgtccagtgtgcagtgcagctggtgcagtcggggggagtcgtggtgcagcctggggggtccctgacactctcctgtgaagcctctggattcacgttcgatgattataccatgcactgggtccgtcaagttccggggaccggtctagagtgggtcgcttttatcagttgggatggtggcgccacagcctatgcagactctttgaagggccgattcaccatctccagagacaacaccaataactccctctttctgcaaatgacgagtctgaagactgacgacactggcttgtattactgtgtcaaagagggtggcgcgataggagccttt

SEQ ID NO: 786607 - DNA, 467 bp, Homo sapiens
  misc_feature: NA.10.6.A06.1.454.heavy.3.zerom50
agggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtctgggggaggcctggtcaaggccgggggggtctctgagactgtcctgtgttgcctctggattccctctcaggagtttcagcatgaactgggtccgccaggctccagggaagggcctggagtgggtcgcaaccatcagcagtatttccagttacatatactacgcagaatctgtgaagggccgcttcaccatctccagagacgacgccaggaactcaatgtggctgcaaatgaacagcctgggagccgaggacacggcaagatattactgtgcgagagctttaatggttcggtgataactgggaacgacgtacg

SEQ ID NO: 786608 - DNA, 480 bp, Homo sapiens
  misc_feature: NA.3.6.A06.1.454.heavy.3.zerom50
aagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagtcgtttttactactactggagttggatccggcagtccccagggaagggactagagtgggttggccatatgcatcacagtgggagcaccaactacaacccctccctcgagagtcgagtcaccatatcaatagacacgtccaagaaccagttctccctgagcttgaagtctgtcaatgctgcggacacggccgtttattactgtgcgagtactgcggggaaagatccatttgatatttggggccaaggaacaatggtcaccgtctcttcagcctccaccaagggcccc

SEQ ID NO: 786609 - DNA, 478 bp, Homo sapiens
  misc_feature: NA.53.12.B01.1.454.heavy.3.zerom50
tccggggctgaactgaagaagcctggggcctcagtgaaggtttcctgcaaggcatccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgttttatagtgggagctgccccaagatcgccattccactttgactactggggccagggaacactggtcaccgtctcctcagcctccaccaagggcccatcggtcttccccctggcaccctcctccaagagcacctctgggggcacagcggccctgggctgcctggtcaaggactacttcctcgtactgcgctgac

SEQ ID NO: 786610 - DNA, 456 bp, Homo sapiens
  misc_feature: NA.47.48.E04.1.454.heavy.3.zerom50
ctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctcggccggaccttggcttcggc

SEQ ID NO: 786611 - DNA, 681 bp, Homo sapiens
  misc_feature: NA.53.14.B03.1.454.heavy.3.zerom50
gggggcccgggcgacctggcgcatctacaactatccccacttccccttctcgcacagtaatatacaacccgtgtcttcagatctcaggctgctcagttccatgtaggctgtgctcgcggatgtgtccctggtgatggtgactctgccctggaacttctgtgaatagtgtctgtcaccattgccagcgctgatccatcccatccactcaagtctttgtccgcgggcctggcgcacccaatggatagcatgggtactgagggtgtatccagaagcctggcaggaaaccttcactgaggccccaggcttcttcgcctcagccccagactgcacaagctggacctgggagtgggcacctgtggctgctgccaccaaaaagaggatcctccaggtccagtccatggtgaggcgttgtgctctgggggcttctgaggagggatgtggttgttgggtcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatattgtagatgcgccaggtgcccggccggccccctactttgactacgtgggggccggggaaccctggtcaccgttccg

SEQ ID NO: 786612 - DNA, 308 bp, Homo sapiens
  misc_feature: NA.8.12.B01.1.454.heavy.3.zerom50
tttggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaaatgacctctggggccagggaaccctggtcaccgtctcctcagcctccaccaagggcccatcggtcttccccctggcgccctgctccaggagcacctccgagagcacagcggccctgggctgcctggtcaaggactacttccgacacgcgag

SEQ ID NO: 786613 - DNA, 500 bp, Homo sapiens
  misc_feature: NA.11.76.G10.1.454.heavy.3.zerom50
aggggaggtctgagagaggagccccgccctgggatttgcaggtattttcattgggtgctcaggactgaacaaagagaactcaccatggaactcgggctgagctggctttttcttgtggctattttaaaaggtgtccagtctacaacgagactactggaatctgggggcgacttcgtgctgccgggagggtccctgagactctcctgtgcagcctctggattccccttgattcactttcacatggcctgggtccgccaagctccaggggggagattggagtgggtcgcctccatgaattcgaattcttatgacaatttgtatgcggactccgtgaaggggcgatttactgtcgccgcagacaagtcgaacaacaccttattcctccacattaccaacgcgacagtcgaagacacggccaaatatttctgtgcgaagggtggttttcgttgggggcaattgtcgccttgactgctggggccagggaaccctggtcaccgtcc

SEQ ID NO: 786614 - DNA, 475 bp, Homo sapiens
  misc_feature: NA.53.47.E03.1.454.heavy.3.zerom50
agagagaagggggagagaggagcccagccctgggattttcaggtgttttcatttggtgatcaggactgaacagagagaactcaccatggagtttgggctgagctggctttttcttgtggctgttttaaaaggtgtccagtgtgaggtgcggctgttggaatctgggggaggcttggttcagccgggggggtccctgagactctcctgtgccgtctctggattcacctttagagtctatgccatgcactgggtccgccaggctccagggaggggactagagtgggtctctgccatcagtgggagtggtgatgtcagatactacggagacaccatcaagggccgcttcacgatctcgagagacaactccaagaataccctctatctacacatagaaaaacgtcagagccgacgacacggccgtctattactgcgcaaagtgggtcacagactacgatgatactagtggttatttacg

SEQ ID NO: 786615 - DNA, 474 bp, Homo sapiens
  misc_feature: NA.49.49.E05.1.454.heavy.3.zerom50
aacacacaaagggggctttctgagagtcatggatctcatgtgcaagaaagtgaagcacctgtggttcttcctcctgctggtggcggctcccagatgggtcctgtcccagctgcagctacaggagtcgggcccaggactgctgaagccttcggagaccctgtccctcacctgcactgtctctggtggttccttcagtagtccttattactactggggctgggtccgccagcccccagggaagggcctggagtggattgcgaatatctactatagtgggagcacctactacaatccttccctcaagagtcgcgtcactgtgtccgtggacacgtccaagaataaagtctccctgaacctgaactctgtgaccgccgcagacacggctgtctattactgtgccagaacgcggaaatccctacacaatgatgcttttgatgtctggggccatgggacaatggtcaccgtctcttcacg

SEQ ID NO: 786616 - DNA, 538 bp, Homo sapiens
  misc_feature: NA.40.29.C07.1.454.heavy.3.zerom50
agggaaaggggaggtctgggagaggagccccagccgtgagattcccaggagtagggaaagggggctcagcactgaacacagaccaccaaccatggagttagggcctagctggcttttccttgttgctcttttaaagggtgtccgatgtgaggcgcagctggtggagtctgggggaggattggttcagccagggcggtccctgagactctcctgtacagcttctggattcccctttggtgattatacaatacattgggtccgccaggcgccagggaagaggctggagtgggtgggtttcgttagctcgaaaccttatcatgggccacctgaatacgccgcgtctgtgaaaggcagattcatcatctcaagagagaattccaagagcaccgcctatctgcaaatgaacagcctgaaaaccgaggacacagccatatattattgtactggagccgaatttgtacaaatggtgtattccccttcacgtaatggtctttgatatctggggccaggggacacgtggtcaccgtctcttcagtcc

SEQ ID NO: 786617 - DNA, 494 bp, Homo sapiens
  misc_feature: NA.53.21.B10.1.454.heavy.3.zerom50
agggggctctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagagtctatgacatgagttgggtccgccaggctccggggaaggggctggagtgggtctcaacgatcagtgatagcggaagtaccacaaactacgccgcctccgtgaagggccgatgcaccgtctccagacgacaattcgaaggacactttatatctgcaactcaacagactgacaaccgctgacacggccgtctattactgtgtcaaagaaagacggaccgctggacgaggagccgaggaaggaaaatcacttaactttgacctacg

SEQ ID NO: 786618 - DNA, 395 bp, Homo sapiens
  misc_feature: NA.53.40.D07.1.454.heavy.3.zerom50
taacaacagagggtctgctgggcctcccatggggtgtcctgtcacaggtacagctgcagcagtcaggtccaggactggtgaagccctcgcagaccctctcactcacctgtggcatctccggggacagtgtctctagcaacagcgctgcttggaattggatcaggcagtccccttcgagaggccttgagtggctgggaaggacatactacaggtccaagtggtataatgattatgctgtatctgtaaaagtcgaataagcatcaacccagacacatccaagaaccagttctcccttcagctgaactctgtgactcccgaggacacggctgtctattactgtgcaagtgagtcccgctatagcagtgcctggtcaaggactacttcctcgtactgcg

SEQ ID NO: 786619 - DNA, 457 bp, Homo sapiens
  misc_feature: NA.21.40.D07.1.454.heavy.3.zerom50
taacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagacatactatgtggactctgtgaagggccgattcaccatctccagagacaacgccaagagctcactgtatctgcaaatgaacagcctgagagtcgaggacacggctgtgtattactgtgcgagagactcccctccggtatacgg

SEQ ID NO: 786620 - DNA, 471 bp, Homo sapiens
  misc_feature: NA.43.78.H01.1.454.heavy.3.zerom50
atgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttttatgcctttggattatgktggggccwagbaaaggggacsaatagtcggtwcgtacccg

SEQ ID NO: 786621 - DNA, 504 bp, Homo sapiens
  misc_feature: NA.22.24.C02.1.454.heavy.3.zerom50
tagggaaagggtctccgaaggcttcaacagtcctgtcccaggtgcagctacaacagtggggcgcaggactgttgaagccttcggagaccctgtccctcacctgcgctgtctatggtgggtctttcagtgattactactggagctggatccgccagcccccagggatggggcctggagtggattggggaaatcgatcatactggaagcagcaagaccaacccgtccctcaagaatcgagtcactctgtcagtagacacgtcccggagccagttctccctgaacctgaagtctatgaccgccgcggacacggctgtttattactgtgccggactaaccgtgccgcgtgccttgccccaaagaccctggggccagggaaccctggtcaccgtctcctcagcctccaccaagggcccatcggtcttccccctggcaccctcctccaagacgcacctctgggggcacagcggcccgtgggctgcctggtcaaggactacttccacgtcg

SEQ ID NO: 786622 - DNA, 485 bp, Homo sapiens
  misc_feature: NA.51.10.A10.1.454.heavy.3.zerom50
aggggtctctgagagaggagcccagcccttggattttcaggtgttttcatttggtgatcaggactggacagagagaactcaccatggtttttgggctgagctggttttttcttgtggctattttaaaaggtgtccagtgtgacatgcaactgttggagtctgggggcggcttggttcagccgggggggtccctcagactctcctgttcaacctctggattcacctttagtggctatgccatgagttgggtccgccaggctccagggaaggggctagagtgggtctcaactattaccagtggtggtggaggcagatactattcagactccgtgaggggccggttcaccgtctccagagacaattccaacaacactgtgtctctgctaatgagcagcctgagagccgacgacacggccgtatattactgtgcgaaagatctccgggggcagttcttcgtggatgcgacctctttttctactatggtc

SEQ ID NO: 786623 - DNA, 471 bp, Homo sapiens
  misc_feature: NA.53.19.B08.1.454.heavy.3.zerom50
aggggtctgggagacgagcccagcactggaagtcgccggtgtttccattcggtgatcatcactgaacacagaggactcaccatggagtttgggctgacctgggttttcttcgttgctcttttaagaggtgtccagtgtcaggtgcagctggtggagtcggggggaggcgtggtccagcctgggaagtccctgagactctcctgtgcggcctctggattcagtttcagttggtacggcatgcactgggtccgtcaggctccaggcaaggggctggagtgggtggcaattatatcgtatgatggaaccaaaagaaactacgcagactccgtgaagggccgcttcagtatctccagagacgatcgccgggacaccctttatttgcaaatgagcagcctgagagttggagacacggctgtatattactgtgcgagagacaaacctgaatatagcactggctggcagggccttacg

SEQ ID NO: 786624 - DNA, 464 bp, Homo sapiens
  misc_feature: NA.48.84.H07.1.454.heavy.3.zerom50
catcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcggcggggaggtggacggagccgttcgggtttcggaggtttactcagtctactaccttt

SEQ ID NO: 786625 - DNA, 476 bp, Homo sapiens
  misc_feature: NA.22.73.G07.1.454.heavy.3.zerom50
agggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggactggagtggattgggtatatctattacactgggagcaccgactacagcccctccctcatgagtcgagtcaccatttcactagacacgtccaagaaccagttctccctgaaactgaggtctgtgaccgctgcggacacggccgtctattactgtgcgagatttgctttttggagtggttacgccgcgtttgactactggggccagggaaccctggtcaccgtctcctcagcctccaccaacc

SEQ ID NO: 786626 - DNA, 341 bp, Homo sapiens
  misc_feature: NA.19.80.H03.1.454.heavy.3.zerom50
aagggaaaggggctggagtgggtggccaacataaagccagatggaagtgagagatcttatgtggactctgtgaagggccgattcagcatctccagagacaacgccaagaattcactgtttctgcaaataaacagcctgagagccgaggacacggctgtctactattgtgtgagagaggataagaatacttttgatttctggggccaggggacaacggtcaccgtctcttcagcctccaccaagggcccatcggtcttccccctggcgccctgctccaggagcacctccgagagcacagcggccctgggctgcctggtcaaggactacttcccacgagagta

SEQ ID NO: 786627 - DNA, 455 bp, Homo sapiens
  misc_feature: NA.48.69.G03.1.454.heavy.3.zerom50
atgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatgcctttgatatrtgtgggscgaagggacaagtggtaccg

SEQ ID NO: 786628 - DNA, 475 bp, Homo sapiens
  misc_feature: NA.53.74.G08.1.454.heavy.3.zerom50
agggggagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtagagcctggggggtccctgagactctcctgtgcagcctctggattcacctttagcagctacgccatgagctgggtccgccaggctccagggaaggggctggagtgggtctcagcaattactggtggtggtggtagggcatactacgcagactccgtgaggggccggttcaccatctccagtgacaattccaagaacacgctgtatctgcaaatgaacagcctgagagccgaggacacggccgtttattactgtgcgaaacacatttttggactccttgccatagacgcctactactttgactacg

SEQ ID NO: 786629 - DNA, 467 bp, Homo sapiens
  misc_feature: NA.53.54.E10.1.454.heavy.3.zerom50
aacacacaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtccgggggaggcgtggtccagcctgggaggtccctgagactctcctgtgtagcctctggattcaccttcagggtctatggcatgaactgggtccgccagactccaggcaaggggctggagtgggtggcatttatatcatttgatggcactaataaatactatgcagactccgtgaggggccgattcaccatctccagagacaattccaagaacatggtgtttctgcaaatgaacagcctgagagttgaagacacggctgtgtattactgtgcgaaacggaatgagtgggaactaggggtcga

SEQ ID NO: 786630 - DNA, 465 bp, Homo sapiens
  misc_feature: NA.53.1.A01.1.454.heavy.3.zerom50
agagggggcatcacataacaaccagattcctcctctaaagaagcccctgggagcacagctcatcaccatggactggacctggaggttcctctttgtggtggcagcagctaccggtgtccagtcccaggtccacctggtgcaatccgggactgaggtgaagaagcctgggtcctcggtgaaggtctcctgcaaggcctctggagacaccttcaacagttatggtatcagttgggtgcgacaggcccctggacaagggcttgagtggatgggaaggatcatcccaatccttggtattacaaaaatgcacagaggtttcagggcagagtcctgttaaccgcggacaaatccactaccacagtctacatggagctgagcagcctgagatctgaagacacggccctgtactattgtgcgagagaaatgtacttctatgacagtactaatcaatatgtcttttgattgttc

SEQ ID NO: 786631 - DNA, 427 bp, Homo sapiens
  misc_feature: NA.4.10.A10.1.454.heavy.3.zerom50
aggggtccctgagactctcctgtgcagcctctggattcaccttcacctcgtatagcatgacctgggtccgccaggctccagggaaggggctggagtgggtctcatccattggtactggtagtccttacatatactacttagactcagtgaggggccgattctccatctccagagacgactccaagaactcagtgtatctgcacatggacagcctgagagccgaggacacggctgtgtatttctgtgggaggtctccggtggtgctgagaaacggcgttgacttctggggccagggaaccctggtcaccgtctcctcagcctccaccaagggcccatcggtcttccccctggcgccctgctccaggagcacctccgagagcacagcggccctgggctgcctggtcaaggactacttccctacagtgct

SEQ ID NO: 786632 - DNA, 480 bp, Homo sapiens
  misc_feature: NA.52.36.D03.1.454.heavy.3.zerom50
atctctcttgggggctctgggagaggagctccagccttgggattcccagctgtctccactcggtgatcggcactgaaaacaggagactcagtatggagtttgggctgagctgggttttccttgttgctattttaaaaggtgtccagtgtgagatgcagctggtggagtctgggggaggcttggtccagcctggggggtccctgaaactctcctgtacagcctctgggttccccttcagtggcactgctatgcactgggtccgccaggtttccgggaaagggctggagtgggttggccgcatcagaggcaaggcaaaaagtcacgcgacggcatatgctgcgtcggtgaaaggcaggttcaccatctccagagatgattcagataacacggcgtatctgcaaatgaacaacctgaaaaccgaagacacggccgtgtattattgtagtagacattcggggggttctggaagtgccacgctcg

SEQ ID NO: 786633 - DNA, 448 bp, Homo sapiens
  misc_feature: NA.40.17.B06.1.454.heavy.3.zerom50
agggggcagagcctgctgaattctggctgactagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctggtaatagtgttgcttggaactggatcaggcagtccccatggagaggccttgagtggctgggaaggacatcctacaggtccgacaggtccgagtggttaaatgaatttgcagtttttgtggaaagtcgaataaccatcaatgcagacacatccaagaaccagttctccctgcacctaaactctatgactcccgaggacgcggctgtttattactgtgcaagaggacgaattgcatactatg

SEQ ID NO: 786634 - DNA, 478 bp, Homo sapiens
  misc_feature: NA.21.78.H01.1.454.heavy.3.zerom50
aagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggggccggggaaccctggtcaccgtctccccaccctccaccaacc

SEQ ID NO: 786635 - DNA, 460 bp, Homo sapiens
  misc_feature: NA.11.16.B05.1.454.heavy.3.zerom50
ttgagctctgggagaagagccccagccccagaattccgaggagtttccattcggtgatcagcactgaacacagaggactcaccatggagtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgccaggctccagggcaggggctggaatggatttcatacattggtgaaagtggcagtcccatataccacgcagactctgtgaagggccggttcaccatctccagggacaactccaaaaactcactatatctggaaatgactagcctgagactcgaggacacggccgtttattactgtgcgacgcccgccgatagcagcatcatctacgc

SEQ ID NO: 786636 - DNA, 472 bp, Homo sapiens
  misc_feature: NA.51.66.F11.1.454.heavy.3.zerom50
agggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaagggggactgaacatctgacgacacggccatgtattattgtgcgagagaaatgttaggtactgctttgggtccctgggggcccgggaacccggggtccg

SEQ ID NO: 786637 - DNA, 369 bp, Homo sapiens
  misc_feature: NA.3.25.C03.1.454.heavy.3.zerom50
atggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccgagtgcgtct

SEQ ID NO: 786638 - DNA, 342 bp, Homo sapiens
  misc_feature: NA.47.60.F05.1.454.heavy.3.zerom50
gggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggcaccctcctccaagagcacctctgggggcacagcggccctgggctgcctggtcaaggactacttcctacgtgagct
